(12) United States Patent
Hey et al.

(10) Patent No.: US 9,447,153 B1
(45) Date of Patent: *Sep. 20, 2016

(54) **MODIFIED *BACILLUS THURINGIENSIS* CRY PROTEINS THAT INHIBIT COLEOPTERANS**

(71) Applicant: Dow AgroSciences LLC, Indianapolis, IN (US)

(72) Inventors: Timothy D. Hey, Zionsville, IN (US); Ignacio M. Larrinua, Indianapolis, IN (US); Kenneth E. Narva, Zionsville, IN (US)

(73) Assignee: Dow AgroSciences LLC, Indianapolis, IN (US)

( * ) Notice: Subject to any disclaimer, the term of this patent is extended or adjusted under 35 U.S.C. 154(b) by 928 days.

This patent is subject to a terminal disclaimer.

(21) Appl. No.: 13/621,582

(22) Filed: Sep. 17, 2012

Related U.S. Application Data

(63) Continuation of application No. 12/512,865, filed on Jul. 30, 2009, now Pat. No. 8,269,069.

(60) Provisional application No. 61/084,944, filed on Jul. 30, 2008.

(51) Int. Cl.
*C07K 14/325* (2006.01)

(52) U.S. Cl.
CPC .................................. *C07K 14/325* (2013.01)

(58) Field of Classification Search
None
See application file for complete search history.

(56) References Cited

U.S. PATENT DOCUMENTS

| | | | |
|---|---|---|---|
| 4,771,131 A | 9/1988 | Herrnstadt | |
| 6,060,594 A * | 5/2000 | English et al. | 536/23.71 |
| 8,269,069 B1 * | 9/2012 | Narva et al. | 800/302 |
| 2003/0120054 A1 | 6/2003 | Chen | |
| 2004/0199939 A1 | 10/2004 | Chen | |
| 2006/0085870 A1 * | 4/2006 | Chen et al. | 800/279 |
| 2006/0288448 A1 | 12/2006 | Abad | |
| 2008/0044907 A1 | 2/2008 | Chen | |
| 2008/0182796 A1 | 7/2008 | Chen | |
| 2009/0265809 A1 | 10/2009 | Chen | |
| 2010/0017914 A1 | 1/2010 | Hart | |

OTHER PUBLICATIONS

Rausell et al 2004, Biochemica et Biophysica Acta 1660: 99-105.*
Rausell et al., Biochimica et Biophysica Acta 2004, 1660: 99-105.
Carroll et al., Intramolecular Proteolytic Cleavage of Bacillus thuringiensis Cry3A δ-Endotoxin May Facilitate Its Coleopteran Toxicity, Journal of Invertebrate pathology, vol. 70, pp. 41-49, 1997.
Soberón et al., Engineering Modified BT Toxins to Counter Insect Resistance, Science, vol. 318, pp. 1640-1642, Dec. 2007.

* cited by examiner

*Primary Examiner* — David H Kruse
(74) *Attorney, Agent, or Firm* — Ronald S. Maciak; Barnes & Thornburg LLP

(57) ABSTRACT

The present invention includes domain I modifications that improve various attributes of various Coleopteran-active Cry proteins. These attributes can include improved target pest spectrum, potency, and insect resistance management. The subject modifications can affect protoxin activation and the efficiency of pore formation, which can lead to enhanced insect intoxication.

9 Claims, 5 Drawing Sheets

```
              1                                                  50
Cry1Ab   (1) --------------------MDNNPNINECIPYNCLSNPEVEVLGGERI
Cry1Ac   (1) --------------------MDNNPNINECIPYNCLSNPEVEVLGGERI
Cry1Ah   (1) MKNSIKLSELWYFNERKWRYFMEIVNNQNQCVPYNCLNNPEIEILEGGRI
Cry1Fa   (1) --------------------MENNIQNQCVPYNCLNNPEVEILN-EER

α-1             ↓     α-2a              α-2b
             51                                                 100
Cry1Ab  (30) ETGYTPIDISLSLTQFLLSEFVPGAGFVLGLVDIIWGIFGPSQWDAFLVQ
Cry1Ac  (30) ETGYTPIDISLSLTQFLLSEFVPGAGFVLGLVDIIWGIFGPSQWDAFLVQ
Cry1Ah  (51) SVGNTPIDISLSLTQFLLSEFVPGAGFVLGLIDLIWGFVGPSQWDAFLAQ
Cry1Fa  (28) STGRLPLDISLSLTRFLLSEFVPGVGVAFGLFDLIWGFITPSDWSLFLLQ

↓              α-3
             101                                                150
Cry1Ab  (80) IEQLINQRIEEFARNQAISRLEGLSNLYQIYAESFREWEADPTNPALREE
Cry1Ac  (80) IEQLINQRIEEFARNQAISRLEGLSNLYQIYAESFREWEADPTNPALREE
Cry1Ah (101) VEQLINQRIAEAVRNTAIQELEGMARVYRTYATAFAEWEKAPDDPELREA
Cry1Fa  (78) IEQLIEQRIETLERNRAITTLRGLADSYEIYIEALREWEANPNNAQLRED

α-4                      α-5
             151                                                200
Cry1Ab (130) MRIQFNDMNSALTTAIPLFAVQNYQVPLLSVYVQAANLHLSVLRDVSVFG
Cry1Ac (130) MRIQFNDMNSALTTAIPLFAVQNYQVPLLSVYVQAANLHLSVLRDVSVFG
Cry1Ah (151) LRTQFTATETYISGRISVLKIQTFEVQLLSVFAQAANLHLSLLRDVVFFG
Cry1Fa (128) VRIRFANTDDALITAINNFTLTSFEIPLLSVYVQAANLHLSLLRDAVSFG

α-6
             201                                                250
Cry1Ab (180) QRWGFDAATINSRYNDLTRLIGNYTDYAVRWYNTGLERVWGPDSRDWVRY
Cry1Ac (180) QRWGFDAATINSRYNDLTRLIGNYTDYAVRWYNTGLERVWGPDSRDWVRY
Cry1Ah (201) QRWGFSTTTVNNYYNDLTEGISTYTDYAVRWYNTGLERVWGPDSRDWVRY
Cry1Fa (178) QGWGLDIATVNNHYNRLINLIHRYTKHCLDTYNQGLENLRGTNTRQWARF

α-7
             251                                                300
Cry1Ab (230) NQFRRELTLTVLDIVALFPNYDSRRYPIRTVSQLTREIYTNPVLEN--FD
Cry1Ac (230) NQFRRELTLTVLDIVALFPNYDSRRYPIRTVSQLTREIYTNPVLEN--FD
Cry1Ah (251) NQFRRELTLTVLDIVALFPNYDSRRYPIRTVSQLTREIYTNPVLEN--FD
Cry1Fa (228) NQFRRDLTLTVLDIVALFPNYDVRTYPIQTSSQLTREIYTSSVIEDSPVS 301                                                350
Cry1Ab (278) GSFRGSAQGIERSIRSPHLMDILNSITIYTDAHRGYYYWSGHQIMASPVG
Cry1Ac (278) GSFRGSAQGIERSIRSPHLMDILNSITIYTDAHRGYYYWSGHQIMASPVG
Cry1Ah (299) GSFRGSAQGIERSIRSPHLMDILNSITIYTDAHRGYYYWSGHQIMASPVG
Cry1Fa (278) ANIPNGFNRAEFGVRPPHLMDFMNSLFVTAETVRSQTVWGGHLVSSR--N 351                                                400
Cry1Ab (328) FSGPEFTFPLYGTMGNAAPQQRIVAQLGQGVYRTLSSTLYRRPFNIGINN
Cry1Ac (328) FSGPEFTFPLYGTMGNAAPQQRIVAQLGQGVYRTLSSTLYRRPFNIGINN
Cry1Ah (349) FSGPEFTFPLYGTMGNAAPQQRIVAQLGQGVYRTLSSTFYRRPFNIGINN
Cry1Fa (326) TAGNRINFPSYGVFNPGG-----AIWIADEDPRPFYRTLSDPVFVRGGFG
```

FIGURE 4 (continued)

```
                401                                               450
Cry1Ab  (378)   QQLSVLDGTEFAYGTSSNLPSAVYRKSGTVDSLDEIPPQNNNVPPRQGFS
Cry1Ac  (378)   QQLSVLDGTEFAYGTSSNLPSAVYRKSGTVDSLDEIPPQNNNVPPRQGFS
Cry1Ah  (399)   QQLSVLDGTEFAYGTSSNLPSAVYRKSGTVDSLDEIPPQNNNVPPRQGFS
Cry1Fa  (371)   NPHYVLGLRGVAFQQTGTNHTRTFRNSGTIDSLDEIPPQDNSGAPWNDYS 451                                               500
Cry1Ab  (428)   HRLSHVSMFRSGFSNSSVSIIRAPMFSWIHRSAEFNNIIPSSQITQIPLT
Cry1Ac  (428)   HRLSHVSMFRSGFSNSSVSIIRAPMFSWIHRSAEFNNIIASDSITQIPAV
Cry1Ah  (449)   HRLSHVSMFRSGSS-SSVSIIRAPMFSWIHRSAEFNNIIASDSITQIPAV
Cry1Fa  (421)   HVLNHVTFVRWPGEISGSDSWRAPMFSWTHRSATPTNTIDPERITQIPLV 501                                               550
Cry1Ab  (478)   KSTNLGSGTSVVKGPGFTGGDILRRTSPG--Q---ISTLRVNITAPLSQR
Cry1Ac  (478)   KGNFLFNGSVIS-GPGFTGGDLVRLNSSGNNIQNRGYIEVPIHFPSTSTR
Cry1Ah  (498)   KGNFLFNGSVIS-GPGFTGGDLVRLNSSGNNIQNRGYIEVPIHFPSTSTR
Cry1Fa  (471)   KAHTLQSGTTVVRGPGFTGGDILRRTSGGP-----FAYTIVNINGQLPQR 551                                               600
Cry1Ab  (523)   YRVRIRYASTTNLQFHTSIDGRPINQGNFSATMSSGSNLQSGSFRTVGFT
Cry1Ac  (527)   YRVRVRYASVTPIHLNVNWGNSSIFSNTVPATATSLDNLQSSDFGYFESA
Cry1Ah  (547)   YRVRVRYASVTPIHLNVNWGNSSIFSNTVPATATSLDNLQSSDFGYFESA
Cry1Fa  (516)   YRARIRYASTTNLRIYVTVAGERIFAGQFNKTMDTGDPLTFQSFSYATIN 601                                               650
Cry1Ab  (573)   TPFNFSNGSSVFTLSAHVFNSGNEVYIDRIEFVPAEVTFEAEYDLERAQK
Cry1Ac  (577)   NAFTSSLGN---IVGVRNFSGTAGVIIDRFEFIPVTATLEAESDLERAQK
Cry1Ah  (597)   NAFTSSLGN---IVGVRNFSGTAGVIIDRFEFIPVTATLEAEYNLERAQK
Cry1Fa  (566)   TAFTFPMSQSSFTVGADTFSSGNEVYIDRFELIPVTATLEAESDLERAQK 651                                               700
Cry1Ab  (623)   AVNELFTSSNQIGLKTDVTDYHIDQVSNLVECLSDEFCLDEKKELSEKVK
Cry1Ac  (624)   AVNALFTSSNQIGLKTDVTDYHIDRVSNLVECLSDEFCLDEKKELSEKVK
Cry1Ah  (644)   AVNALFTSTNQLGLKTNVTDYHIDQVSNLVTCLSDEFCLDEKRELSEKVK
Cry1Fa  (616)   AVNALFTSSNQIGLKTDVTDYHIDRVSNLVECLSDEFCLDEKKELSEKVK 701                                               750
Cry1Ab  (673)   HAKRLSDERNLLQDPNFRGINRQLDRGWRGSTDITIQGGDDVFKENYVTL
Cry1Ac  (674)   HAKRLSDERNLLQDPNFRGINRQLDRGWRGSTDITIQGGDDVFKENYVTL
Cry1Ah  (694)   HAKRLSDERNLLQDSNFKDINRQPERGWGGSTGITIQGVDDVFKENYVTL
Cry1Fa  (666)   HAKRLSDERNLLQDPNFRGINRQLDRGWRGSTDITIQGGDDVFKENYVTL 751                                               800
Cry1Ab  (723)   LGTFDECYLTYLYQKIDESKLKAYTRYQLRGYIEDSQDLEIYLIRYNAKH
Cry1Ac  (724)   LGTFDECYPTYLYQKIDESKLKAYTRYQLRGYIEDSQDLEIYLIRYNAKH
Cry1Ah  (744)   SGTFDECYPTYLYQKIDESKLKAFTRYQLRGYIEDSQDLEVYLIRYNAKH
Cry1Fa  (716)   LGTFDECYPTYLYQKIDESKLKAYTRYQLRGYIEDSQDLEIYLIRYNAKH 801                                               850
Cry1Ab  (773)   ETVNVPGTGSLWRLSAPSPIG------KCAHHSHHFSLDIDVGCTDLNED
Cry1Ac  (774)   ETVNVPGTGSLWPLSAPSPIG------KCAHHSHHFSLDIDVGCTDLNED
Cry1Ah  (794)   ETLNVPGTGSLWPLAVKSPIGRCGEPNRCAHHSHHFSLDIDVGCTDLNED
Cry1Fa  (766)   ETVNVPGTGSLWPLSAPSPIG------KCAHHSHHFSLDIDVGCTDLNED 851                                               900
Cry1Ab  (817)   LGVWVIFKIKTQDGHARLGNLEFLEEKPLVGEALARVKRAEKKWRDKREK
Cry1Ac  (818)   LGVWVIFKIKTQDGHARLGNLEFLEEKPLVGEALARVKRAEKKWRDKREK
Cry1Ah  (844)   LGVWVIFKIKTQDGHAKIGNLEFLEEKLLLGEALARVKKAEKKWRDKREK
Cry1Fa  (810)   LGVWVIFKIKTQDGHARLGNLEFLEEKPLVGEALARVKRAEKKWRDKREK 901                                               950
```

FIGURE 4 (continued)

```
Cry1Ab  (867)  LEWETNIVYKEAKESVDALFVNSQYDRLQADTNIAMIHAADKRVHSIREA
Cry1Ac  (868)  LEWETNIVYKEAKESVDALFVNSQYDRLQADTNIAMIHAADKRVHSIREA
Cry1Ah  (894)  LEWETNIVYKEAKESVDALFVDSQYNRLQTDTNIAMIHAADKRVHRIREA
Cry1Fa  (860)  LEWETNIVYKEAKESVDALFVNSQYDRLQADTNIAMIHAADKRVHSIREA
                951                                             1000
Cry1Ab  (917)  YLPELSVIPGVNAAIFEELEGRIFTAFSLYDARNVIKNGDFNNGLSCWNV
Cry1Ac  (918)  YLPELSVIPGVNAAIFEELEGRIFTAFSLYDARNVIKNGDFNNGLSCWNV
Cry1Ah  (944)  YLPELSVIPGVNAAIFEELEGLIFTAFSLYDARNVIKNGDFNYGLSCWNV
Cry1Fa  (910)  YLPELSVIPGVNAAIFEELEGRIFTAFSLYDARNVIKNGDFNNGLSCWNV
                1001                                            1050
Cry1Ab  (967)  KGHVDVEEQNNHRSVLVVPEWEAEVSQEVRVCPGRGYILRVTAYKEGYGE
Cry1Ac  (968)  KGHVDVEEQNNHRSVLVVPEWEAEVSQEVRVCPGRGYILRVTAYKEGYGE
Cry1Ah  (994)  KGHVDVEEQNNHRSVLVIPEWEAEVSQEVRVCPGRGYILRVTAYKEGYGE
Cry1Fa  (960)  KGHVDVEEQNNHRSVLVVPEWEAEVSQEVRVCPGRGYILRVTAYKEGYGE
                1051                                            1100
Cry1Ab  (1017) GCVTIHEIENNTDELKFSNCVEEEVYPNNTVTCNDYTATQEEYEGTYTSR
Cry1Ac  (1018) GCVTIHEIENNTDELKFSNCVEEEVYPNNTVTCNDYTATQEEYEGTYTSR
Cry1Ah  (1044) GCVTIHEIEDNTDELKFSNCVEEEVYPNNTVTCNDYTATQEEYEGTYTSR
Cry1Fa  (1010) GCVTIHEIENNTDELKFSNCVEEEVYPNNTVTCNDYTATQEEYEGTYTSR
                1101                                            1150
Cry1Ab  (1067) NRGYDGAYESNSSVPADYASAYEEKAYTDGRRDNPCESNRGYGDYTPLPA
Cry1Ac  (1068) NRGYDGAYESNSSVPADYASAYEEKAYTDGRRDNPCESNRGYGDYTPLPA
Cry1Ah  (1094) NRGYDGAYESNSSVPADYASAYEEKAYTDGRRDNPCESNRGYRDYTPLPA
Cry1Fa  (1060) NRGYDGAYESNSSVPADYASAYEEKAYTDGRRDNPCESNRGYGDYTPLPA
                1151                                 1190
Cry1Ab  (1117) GYVTKELEYFPETDKVWIEIGETEGTFIVDSVELLLMEE-
Cry1Ac  (1118) GYVTKELEYFPETDKVWIEIGETEGTFIVDSVELLLMEE-
Cry1Ah  (1144) GYVTKELEYFPETDKVWIEIGETEGTFIVDSVELLLMEE-
Cry1Fa  (1110) GYVTKELEYFPETDKVWIEIGETEGTFIVDSVELLLMEE-
```

MODIFIED *BACILLUS THURINGIENSIS* CRY PROTEINS THAT INHIBIT COLEOPTERANS

CROSS-REFERENCE TO RELATED APPLICATION

This application is a continuation of U.S. patent application Ser. No. 12/512,865, filed Jul. 30, 2009, which claims the benefit of Provisional Application Ser. No. 61/084,944, filed Jul. 30, 2008, the disclosures of which are expressly incorporated by reference herein.

BACKGROUND

Billions of dollars are spent each year to control insect pests and additional billions are lost to the damage they inflict. Synthetic organic chemical insecticides have been the primary tools used to control insect pests but biological insecticides, such as the insecticidal proteins derived from *Bacillus thuringiensis* (Bt), have played an important role in some areas. The ability to produce insect resistant plants through transformation with Bt insecticidal protein genes has revolutionized modern agriculture and heightened the importance and value of insecticidal proteins and their genes.

Western corn rootworm (WCR), *Diabrotica virgifera virgifera* LeConte, is an economically important corn pest that causes an estimated $1 billion revenue loss each year in North America due to crop yield loss and expenditures for insect management (Metcalf 1986). WCR management practices include crop rotation with soybeans, chemical insecticides and, more recently, transgenic crops expressing Bt Cry proteins. However, to date only a few examples of Bt Cry proteins provide commercial levels of efficacy against WCR, including Cry34Ab1/Cry35Ab1 (Ellis et al. 2002), modified Cry3Aa1 (Walters et al. 2008) and modified Cry3Bb1 (Vaughn et al 2005). These Bt proteins are highly effective at preventing WCR corn root damage when expressed in the roots of transgenic corn (Moellenbeck et al. 2001, Vaughn et al. 2005, Syngenta U.S. Pat. No. 7,361,813).

Despite the success of WCR-resistant transgenic corn, several factors create the need to develop additional Bt proteins to control WCR. First, although the current Cry proteins expressed in transgenic corn products are robust in preventing WCR root damage and thereby protecting grain yield, some WCR adults emerge in artificial infestation trials, indicating less than complete larval insect control. Second, development of resistant insect populations threatens the long-term durability of Cry proteins; Lepidopteran insects resistant to Cry proteins have developed in the field for *Plutella xylostella* (Tabashnik, 1994), *Trichplplusia ni* (Janmaat and Myers 2003), and *Helicoverpa zea* (Tabashnik et al. 2008). Development of new high potency Cry proteins will provide additional tools for WCR management. Cry proteins with different modes of action can be expressed in combination in transgenic corn to prevent the development WCR insect resistance and protect the long term utility of Bt technology for WCR control.

*Bacillus thuringiensis* (Bt) is a soil-borne bacterium that produces insecticidal crystal proteins known as delta endotoxins, or Cry proteins (reviewed in Schnepf et al., 1998). Many *B. thuringiensis* serovars exist in nature that together account for a large number of diverse Cry proteins with various insecticidal properties (see Worldwide Website: life-sci.sussex.ac.uk/home/Neil_Crickmore/Bt/intro.html). Cry proteins are oral intoxicants that function by acting on midgut cells of susceptible insects. The active form of many Cry proteins comprises three distinct protein domains. Domain I is a seven α-helix bundle in which six helices surround a central helix. This domain is involved in midgut membrane insertion and pore formation. Domain II is formed by three antiparallel beta sheets packed together in a beta prism. In Cry1A proteins, surface exposed loops at the apices of domain II beta sheets are involved in binding to lepidopteran cadherin receptors; Cry3Aa domain II loops bind a *Leptinotarsa decemlineata* (Say) (Colorado potato beetle; CPB) membrane-associated a metalloprotease in a similar fashion (Ochoa-Campuzano et al. 2007). Domain III is a beta sandwich structure that interacts with a second class of receptors, examples of which are aminopeptidase and alkaline phosphatase in the case of Cry1A proteins (Piggot and Ellar, 2007). Analogous Cry domain III receptors have yet to be identified in Coleoptera.

One proposed model for Cry protein mode of action is based on pore formation in the midgut membranes of susceptible insects (Knowles and Ellar, 1987). In the most current version of this model (Bravo et al. 2007), binding to both cadherin and aminopeptidase receptors on Lepidopteran midgut membranes are required for Cry protein toxicity. According to the pore formation model, Cry protein intoxication involves several steps: 1) Proteolytic processing of soluble Cry protoxin to an activated core toxin; 2) Cry protein binding to cadherin receptors on the insect midgut; 3) further proteolytic cleavage at the core toxin N-terminus to remove an α-helical region; 4) Cry protein oligomerization to form a pre-pore; 5) pre-pore binding to second site membrane receptors (aminopeptidases and alkaline phosphatases); 6) pre-pore insertion into the membrane and 7) osmotic cell lysis leading to midgut disruption and insect death.

α-helices 4 and 5 of domain I are known to play roles in membrane insertion and pore formation (Walters et al. 1993, Gazit et al. 1998; Nunez-Valdez et al. 2001; FIG. 2), with the other helices proposed to contact the membrane surface like the ribs of an umbrella (Gazit et al. 1998; FIG. 3). Chymostrypsin activation of Cry3Aa1 occurs via cleavage in the loop region between domain I α-helix 3 and α-helix 4 (Carrol et al. 1997). Some α-helix 3 mutants are able to bind receptors but do not form oligomers and are non-toxic to *Manduca sexta* (reviewed in Jimenez-Juarez et al. 2008). Gazit et al. 1998 showed that α-helix 1 does not bind phospholipid membranes. In Cry1A proteins α-helix 1 is removed following receptor binding and is followed by oligomerization (Gomez et al. (2002). Soberon et. al (2007) have further shown that N-terminal deletion mutants of Cry1Ab and Cry1Ac lacking approximately 60 amino acids encompassing α-helix 1 on the three dimensional Cry structure are capable of assembling ca. 60 kDa monomers into pre-pores. These results contrast with those of Hofte et al. 1986 who reported that deletion of 36 amino acids from the N-terminus of Cry1Ab resulted in loss of insecticidal activity. (Hofte et al., "Structural and functional analysis of a cloned delta endotoxin of *Bacillus thuringiensis berliner* 1715" *Eur. J. Biochem.* 161; 273-280 (1986).)

Cry3Aa1 is the best studied three domain Coleopteran-active Bt protein. Cry3Aa1 mode of action follows similar steps as described above for Lepidopteran-active Cry proteins (Bravo et al. 2007). However, there are fundamental differences in the activation steps for Coleopteran-active Cry protoxins. The midgut of coleopteran insects is slightly acidic rather than alkaline as in the case of Lepidopterans (Koller et al 1992) and native Cry3Aa1 is not soluble under acidic conditions. Processing with chymotrypsin resulted in conversion of the full length 67 kDa polypeptide to a 55 kDa derivative that was fully soluble across a broad pH range and retained activity against Colorado potato beetle (Carroll et al. 1997).

BRIEF SUMMARY

The present invention includes domain I modifications that improve various attributes of various Coleopteran-active Cry proteins. These attributes can include improved target pest spectrum, potency, and insect resistance management. The subject modifications can affect protoxin activation and the efficiency of pore formation, which can lead to enhanced insect intoxication.

BRIEF DESCRIPTION OF THE DRAWINGS

Figures 2, 3:
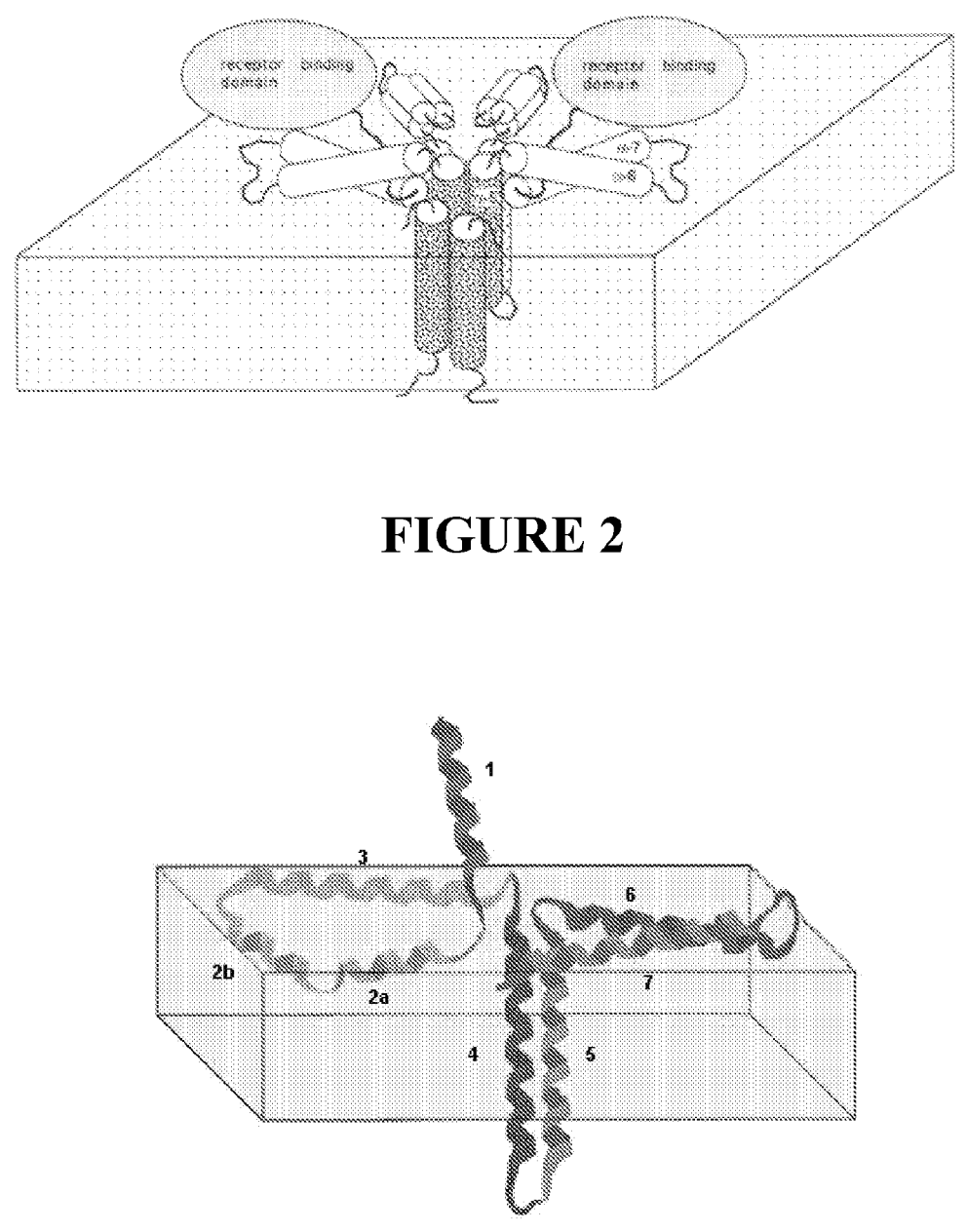

FIG. 2 is a schematic representation of a proposed model for the interaction of domain I alpha helices with phospholipid membranes (Gazit et al. 1998).

FIG. 3 is a schematic representation of a Cry protein oligomeric pore (Gazit and Shai 1995).

FIG. 4 is a multiple sequence alignment of Coleopteran-active Cry proteins. Locations of alpha helices are indicated.

BRIEF SUMMARY OF THE SEQUENCES

Figure 1:
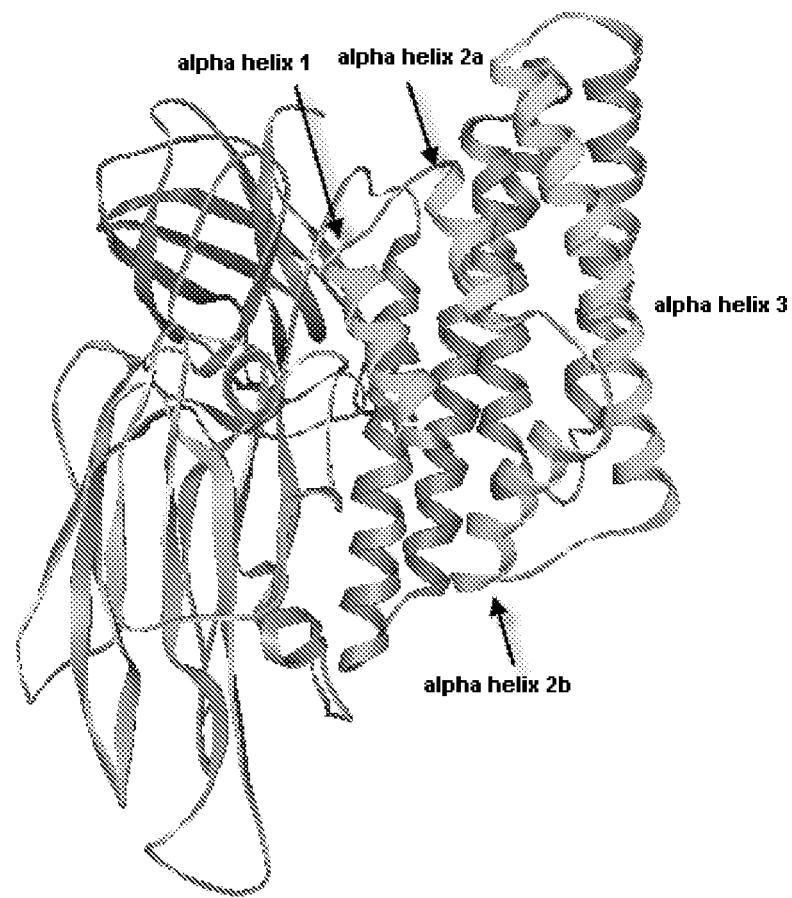
FIG. 1 is a ribbon diagram of the crystal structure of Cry3Aa1 (after Li et al. 1991). Alpha helices 1, 2a and 2b are indicated.

SEQ ID NOS: 1-109 are Cry3Aa deletions as explained herein.

SEQ ID NOS: 110-220 are Cry3Ba deletions as explained herein.

SEQ ID NOS: 221-326 are Cry7Ab deletions as explained herein.

SEQ ID NOS: 327-436 are Cry8Ba deletions as explained herein.

SEQ ID NO: 437 is the full-length Cry3Aa sequence.
SEQ ID NO: 438 is the full-length Cry3Ba sequence.
SEQ ID NO: 439 is the full-length Cry7Ab sequence.
SEQ ID NO: 440 is the full-length Cry8Ba sequence.
SEQ ID NOs:441 and 442 are DNA and protein sequences for DIG-230
SEQ ID NOs:443-462 are DNA and protein sequences for DIG-230 protease site variants
SEQ ID NO: 463-466 are protein sequences for Cry1Ab, Cry1Ac, Cry1Ah and Cry1Fa respectively.

A further supplement Sequence Listing in txt format is submitted to include these sequences in the originally filed drawing FIG. 4. No new matter is submitted by this amendment.

DETAILED DESCRIPTION

Several Coleopteran-active Cry proteins comprise three distinct domains (FIG. 1) that function in a multi-step process leading to pore formation as described above. The present invention relates to improved Cry proteins designed to have N-terminal deletions in regions with putative secondary structure homology to α-helix one and α-helix 2 in domain I of Cry3Aa. These modified Cry proteins have surprisingly improved activity on Coleopteran pests including (*Diabrotica virgifera virgifera*), (*Diabrotica barberi*), and (*Diabrotica virgifera zeae*).

Specifically, the subject inventors sought to further improve upon Coleopteran activity of Cry3Aa1 (U.S. Pat. No. 4,771,131), Cry3Ba1 (U.S. Pat. No. 4,996,155), Cry7Ab1 (U.S. Pat. No. 5,286,486) and Cry8Ba1 (U.S. Pat. No. 5,554,534). To improve insecticidal properties of these Cry proteins, serial, step-wise deletions are described that remove part of the gene encoding the N-terminus of each respective Cry protein. The deletions remove all of α-helix 1 and all or part of α-helix 2 in domain I, while maintaining the structural integrity of the α-helices 3 through 7.

The range of independent deletions in each series is shown in Table 1 below. (Unless indicated otherwise, all residue numbering discussed herein is with respect to the respective full-length sequences (SEQ ID NOS: 437-440).

TABLE 1

N-terminal deletion series for four Cry proteins.

| Cry protein | N-terminal amino acid residue series |
|---|---|
| Cry3Aa1 | F92 through N146 |
| Cry3Ba1 | F92 through E147 |
| Cry7Ab1 | G77 through Q132 |
| Cry8Ba1 | F88 through E144 |

Deletions were designed as follows. The first sequence in each Cry protein deletion series begins near the N-terminus of α-helix 2a (FIG. 4). Serial, stepwise deletions removing single amino acid residues are then constructed that processively remove α-helix 2a and α-helix 2b. The last deletion in each series begins near the N-terminus of α-helix 3. An initiator methionine codon was added to the beginning of each deleted gene. In addition, a second version of each deleted protein was created where glycine was added at position 2 for protein stability (Varshaysky 1997).

Preferred modified Cry proteins include but are not limited to SEQ ID NOS: 2, 35, 110, 145, 221, 254, 328, 362.

For Cry3Aa the N-terminally deleted variants include the following:
SEQ ID NO 2 Deleted residues 1-91, N-terminus at the beginning of α-helix 2a
SEQ ID NO 35 Deleted residues 1-109, N-terminus at the beginning of α-helix 2b For Cry3Ba the N-terminally deleted proteins include:
Seq ID NO 110 Deleted residues 1-91, N-terminus at the beginning of α-helix 2a
Seq ID NO 145 Deleted residues 1-109, N-terminus at the beginning of α-helix 2b For Cry7Ab the N-terminally deleted proteins include:
Seq ID NO 221 Deleted residues 1-76, N-terminus at the beginning of α-helix 2a
Seq ID NO 254 Deleted residues 1-94, N-terminus at the beginning of α-helix 2b For Cry8Ba the N-terminally deleted proteins include:
Seq ID NO 328 Deleted residues residues 1-87, N-terminus at the beginning of α-helix 2a
Seq ID NO 362 Deleted residues residues 1-105, N-terminus at the beginning of α-helix 2b Genes encoding the improved Cry proteins described herein can be made by a variety of methods well-known in the art. For example, synthetic genes and synthetic gene segments can be made by phosphite trimester and phosphoramidite chemistry (Caruthers et al, 1987). Full-length genes can be assembled in a variety of ways including, for example, by ligation of restriction fragments or polymerase chain reaction assembly of overlapping oligonucleotides (Stewart and Burgin, 2005). Further, terminal gene deletions can be made by PCR amplification using site-specific terminal oligonucleotides.

WCR protease recognition sequences can be inserted at specific sites in the Cry protein structure to affect protein processing at desired deletion points within the WCR midgut. Midgut proteases that can be exploited for activation of Cry proteins include by way of example cathepsin B or cathepsin L (Bown et al 2004), chymotrypsin and Asp-N endopeptidase. Further, recognition sites identified empirically by sequencing Cry protein digestion products generated with unfractionated WCR midgut protease preparations can be engineered to effect protein activation. Modified Cry proteins generated either by gene deletion or by introduction of protease cleavage sites have improved activity on Coleopteran pests including (*Diabrotica virgifera virgifera*), (*Diabrotica barberi*), and (*Diabrotica virgifera zeae*).

It is known in the art that many B.t. Cry proteins are about 130 kDa in their full-length form. Proteins exemplified herein represent "core toxins." B.t. core toxins can be used in conjunction with C-terminal "tails." The tails can be the natural "tails" or they can be synthetic tails, such as those disclosed in U.S. Pat. Nos. 6,218,188 and 6,673,990.

As stated herein, modified proteins of the subject invention can have surprisingly improved activity against one or more Coleopteran pests including (*Diabrotica virgifera virgifera*), (*Diabrotica barberi*), and (*Diabrotica virgifera zeae*). Various other insects that can also be targeted or otherwise inhibited/controlled by (one or more of) the subject proteins include:

*Anthonomus grandis*, boll weevil
*Bothyrus gibbosus*, carrot beetle
*Chaetocnema pulicaria*, corn flea beetle
*Colaspis brunnea*, grape *colaspis*
*Cyclocephala borealis*, northern masked chafer (white grub)
*Cyclocephala immaculata*, southern masked chafer (white grub)
*Diabrotica longicornis barberi*, northern corn rootworm
*Diabrotica undecimpunctata howardi*, southern corn rootworm
*Diabrotica virgifera virgifera*, western corn rootworm
*Eleodes, Conoderus*, and *Aeolus* spp., wireworms
*Epilachna varivestis*, Mexican bean beetle
*Hypera punctata*, clover leaf weevil
*Lissorhoptrus oryzophilus*, rice water weevil
*Melanotus* spp., wireworms
*Oulema melanopus*, cereal leaf beetle
*Phyllophaga crinita*, white grub
*Phylotreta* spp., flea beetles including canola flea beetle
*Popillia japonica*, Japanese beetle
*Sitophilus oryzae*, rice weevil
*Sphenophorus maidis*, maize billbug
*Zygogramma exclamationis*, sunflower beetle Any genus listed above (and others), generally, can also be targeted as a part of the subject invention. Any additional insects in any of these genera (as targets) are also included within the scope of this invention.

The subject protein toxins can be "applied" or provided to contact the target insects in a variety of ways. For example, transgenic plants (wherein the protein is produced by and present in the plant) can be used and are well-known in the art. Expression of the toxin genes can also be achieved selectively in specific tissues of the plants, such as the roots, leaves, etc. This can be accomplished via the use of tissue-specific promoters, for example. Spray-on applications are another example and are also known in the art. The subject proteins can be appropriately formulated for the desired end use, and then sprayed (or otherwise applied) onto the plant and/or around the plant/to the vicinity of the plant to be protected—before an infestation is discovered, after target insects are discovered, both before and after, and the like. Bait granules, for example, can also be used and are known in the art.

The subject proteins can be used to protect practically any type of plant from damage by a coleopteran insect. Examples of such plants include maize, sunflower, soybean, cotton, canola, rice, sorghum, wheat, barley, vegetables, ornamentals, peppers (including hot peppers), sugar beets, fruit, and turf, to name but a few.

All patents, patent applications, provisional applications, and publications referred to or cited herein are incorporated by reference in their entirety to the extent they are not inconsistent with the explicit teachings of this specification.

Unless specifically indicated or implied, the terms "a", "an", and "the" signify "at least one" as used herein.

Following are examples that illustrate procedures for practicing the invention. These examples should not be construed as limiting. All percentages are by weight and all solvent mixture proportions are by volume unless otherwise noted.

EXAMPLES

Example 1

Construction of Modified Bt Cry Proteins and Expression in Bacterial Hosts

Standard cloning methods were used in the construction of *P. fluorescens* expression plasmids. Restriction endonucleases were obtained from New England Biolabs and T4 DNA Ligase (Invitrogen, Cat#15224-025) was used for DNA ligation. Plasmid preparations were performed using the Machery-Nagel Nucleobond Xtra Kit (Cat#740-410) or the Plasmid Midi Kit (Qiagen, Cat#12143), following the instructions of the manufacturers. DNA fragments were purified using the Millipore Ultrafree-DA cartridget (Cat#42600) after agaraose tris-acetate gel isolation. All cloning PCR reactions were performed using Phusion High-Fidelity PCR Master Mix (New England Biolabs, Cat# F-531 S), according to the manufacturers' suggested protocols.

Plasmid constructs carrying full length genes encoding Cry3Aa1, Cry3Ba1, Cry7Ab1 and Cry8Ba1 variants were used as templates to amplify modified genes encoding N-terminal deletions or insertions. Each plasmid DNA was first prepared from the original host using the Nucleobond kit. The toxin coding region was PCR-amplified using the purified plasmid DNA as template. The 5' forward primer included specific restriction sites to facilitate insertion into expression vectors as well as a Shine-Dalgarno (ribosome binding) sequence with appropriate spacing upstream of the initiating methionine codon. The forward primers bound to the full length templates at positions to create the truncated reading frames. A glycine codon was inserted as the second residue on deletions that had possible destabilizing residues at the second position. If the deletion already had a glycine or valine residue in the second position it was not modified. These guidelines were as described in A. Varshaysky (1997). The reverse primer or 3' primer bound to the end of the full length coding region and carried a translational stop signal and unique restriction sites to facilitate cloning into expression vectors. Alternatively, protease cleavage sites are introduced at desired deletion locations by gene synthesis or splice overlap PCR (Horton et al. 1989).

The PCR product was then subcloned into pPCR-Script Cam SK(+) from Stratagene (Cat#211192) according to the manufacturer's protocol. The entire PCR fragment was confirmed by sequencing, before restriction digestion with the appropriate enzymes and subsequent cloning into *P. fluorescens* expression vector pDOW1169.

The basic cloning strategy was to subclone the modified Cry coding sequences (CDS) into pDOW1169 at the SpeI and XhoI restriction sites. A pair of gene-specific forward and reverse primers was designed for amplification of each toxin CDS from the source plasmid via PCR such that appropriate restriction enzymes were introduced at each end of the CDS for cloning into pDOW1169. For ligation to the SpeI site of pDOW1169, the forward primer of each set contained a restriction enzyme recognition site and a ribosome binding site, followed by the translation start codon ATG and a stretch of nucleotides homologous to the 5' end of the toxin CDS. For ligation to the XhoI site of pDOW1169, the reverse primer contained a stretch of nucleotides homologous to the 3' end of the toxin CDS, followed by a series of three stop codons for translation termination and a restriction recognition site.

Construction of Expression Strains

The PCR product of each cry gene was digested with the appropriate restriction enzymes and ligated into the SpeI and XhoI sites in pDOW1169 directly downstream of the Ptac promoter. Each of the expression plasmids was transformed into DC454, the standard wild-type *P. fluorescens* strain, or its derivatives, by electroporation, recovered in SOC-Soy hydrolysate medium and plated on selective medium (M9 glucose agar with additive, if necessary). Colonies were first screened by PCR and positive clones were then analyzed by restriction digestion of miniprep plasmid DNA. Selected clones containing inserts were sequenced.

DNA Sequencing

Clones were analyzed by sequencing using Big Dye Terminator version 3.1 (Applied Biosystems) or sent out for commercial sequencing (MWG Biotech, Inc. High Point, N.C.). Reactions consisted of 3.5 uL 5× sequencing buffer, 1 uL premix, 1 uL primer (6.4 uM), 50 fmol (200 ng) of DNA template, and $H_2O$ to adjust volume to 20 uL. Sequencing reactions were purified using Sephadex G-50 (Sigma) and loaded onto the ABI Prism 3100 Genetic Analyzer (Applied Biosystems). Sequence data were assembled and analyzed using the Sequencher software (Gene Codes Corp.).

Growth and Expression Analysis in Shake Flasks

The *P. fluorescens* strains that carried the expression constructs were analyzed by shake-flask expression. Briefly, seed cultures grown in M9 medium, supplemented with 1% glucose and trace elements, were used to inoculate 50 mL of defined minimal salts medium with 9.5% glycerol as the carbon source at ~2% inoculum. Following an initial growth phase at 30° C. with shaking for 24 hours, expression via the Ptac promoter was induced with 0.3 mM isopropyl-β-D-1-thiogalactopyranoside (IPTG). Cultures were sampled at the time of induction and at various times post-induction. Cell density was measured by optical density at 600 nm (OD600).

Cell Fractionation and SDS-PAGE Analysis of Shake Flask Samples

At each sampling time, the cell density of samples was adjusted to OD600=20 and 1 mL aliquots were centrifuged at 14000×g for five minutes and the cell pellets were frozen at −80° C.

Soluble and insoluble fractions from frozen shake flask cell pellet samples were generated using EasyLyse Bacterial Protein Extraction Solution (Epicentre Technologies). Each pellet was resuspended in 1 mL EasyLyse solution and further diluted 1:4 in lysis buffer and incubated with shaking at room temperature for 30 minutes. The lysate was centrifuged at 14,000 rpm for 20 minutes at 4° C. and the supernatant was recovered as the soluble fraction. The pellet (insoluble fraction) was then resuspended in an equal volume of PBS.

Samples were mixed 1:1 with 2× Laemmli sample buffer containing β-mercaptoethanol (Bio-Rad) and boiled for 5 minutes, prior to loading onto Criterion XT Bis-Tris 12% gels. Electrophoresis was performed in the recommended XT MOPS buffer. Gels were stained with Bio-Safe Coomassie Stain according to the manufacturer's protocol and imaged using the Alpha Innotech Imaging system.

Inclusion Body Preparation

Inclusion body preparations were done on *P. fluorescens* fermentations that showed insoluble Bt insecticidal protein production by SDS-PAGE and MALDI-MS. *P. fluorescens* fermentation pellets were thawed from the freezer in ambient temperature water bath. The cells were resuspended to 10% w/v in lysis buffer (50 mM Tris, pH7.5, 200 mM NaCl, 5% Glycerol, 2 mM EDTA, 0.5% Triton X-100, and 1 mM—added just prior to use). 25 mL protease inhibitor cocktail (Sigma or AEBSF 1 mM Biosynth AG) was added for every 100 g of cell paste. The slurry was passed two times through a Microfluidics Microfluidizer at 12000+ psi. The lysate was centrifuged in JLA 10.500 rotor, 18,000×g at 4° C. for 30 min. The supernatant was retained. The inclusion pellet was washed in wash buffer (50 mM Tris, pH7.5, 200 mM NaCl, 5% Glycerol, 2 mM EDTA, 1 mM DTT) 2-3 times (or more, until no bacterial odor remains), by gently homogenizing using a spatula or mechanical mixer and centrifuging as described each time. The resultant supernatants and final pellet were retained and stored at −20° C. Small aliquots of each sample were taken and stored in a microcentrifuge tube for PAGE analysis. The inclusion body preparation pellets were then freeze-dried using a Virtis Advantage freeze dryer at ambient shelf temperature and a maximum vacuum drawn for 2 days. The resulting powders were then stored at −20° C.

SDS-PAGE Analysis

Frozen fermentor cell broths (100 μt) were diluted in chilled water by 5 fold and 200 uL sonicated for 10 minutes (Branson Ultrasonics). The lysates were centrifuged at 14000 rpm for 20 minutes (4° C.) and the supernatants removed (soluble fraction). The pellets were then resuspended in 200 uL of phosphate buffered saline (pH 7.2). Further dilutions of both the soluble and insoluble fractions of an equivalent of up to 20 fold of the original fermentation broth were performed in phosphate buffered saline. These fractions were then mixed 1:1 with Laemmli sample buffer with β-mercaptoethanol and boiled for 5 minutes prior to loading 10-20 uL on a Criterion 10% Bis-Tris gel with MOPS buffer. Gels were stained with Simply Blue SafeStain.

SDS-PAGE analysis and quantitation of IB preparations was done by resuspending 25 mg of IB pellet in 1 mL HTS buffer (20 mM Tris, pH 7.5, 50 mM NaCl, 5% v/v glycerol, 10 mM EDTA disodium salt, 0.5% v/v Triton X-100) and sonicated for 1 minute on ice. The resuspended samples were then diluted 1:1 in Laemmli buffer containing 0.2M DTT. The samples were then diluted 10× and 20× with Laemmli buffer lacking DTT and 10 μL was loaded on to a Criterion 18 well 10% Bis-Tris gel run with 1× NuPAGE MES buffer. Gels were run for 5 min at 100V and then 45 min at 200V. Gels were then washed in water for 20 min and stained with Simply Blue Safe Stain. Quantification of target bands was done by comparing densitometric values for the bands against a BSA densitometric standard curve run on the same gel.

Example 2

Insecticidal Activity of Modified Cry Proteins Expressed in *Pseudomonas Fluorescens*

Modified Cry proteins listed as SEQ ID NO. 1 through 436 are demonstrated to be active on corn rootworm species including the southern corn rootworm (SCR), *Diabrotica undecimpunctata howardi* Barber, and the western corn rootworm (WCR), *Diabrotica virgifera virgifera* LeConte.

Sample Preparation and Bioassays

Inclusion body powders from the relevant *P. fluorescens* strains are suspended in 100 mM carbonate buffer, pH 11 (approximately 120 mg powder per 3.5 ml buffer). They are incubated overnight at 4° C. on a rocker, and then for about an hour at room temperature, in order to solubilize the toxins. Suspensions are centrifuged at 15,000×g for 20 minutes to pellet insoluble material. To prepare for bioassays, the samples are then transferred to 10 mM CAPS, pH 10 using disposable PD-10 columns (GE Healthcare). All subsequent dilutions of the samples are prepared using 10 mM CAPS, pH 10 and all bioassays contained a treatment of this buffer only which served as a background check.

To quantify toxins in bioassay buffer, samples are prepared for gel electrophoresis by diluting 20-50× into NuPAGE reducing sample buffer (Invitrogen) and heated to 70° C. for 10 minutes. Using BSA to create a standard curve for gel densitometry, varying amounts of toxin sample are loaded on the same gel. The gels are run in MES buffer according to manufacturer's instructions and then stained with a Coomassie Blue based stain. Gels are destained until the background cleared and then are scanned using a BioRad imaging system (Biorad Fluor-S MultiImager with Quantity One software version 4.5.2). BSA standard curves are generated by the software and used to calculate concentrations of toxin in solution.

Bioassays are conducted with first instars on artificial diet in 128-well trays specifically designed for insect bioassays (Bio-Serv, Frenchtown, N.J.). Samples are pipetted into each well so that the surface of the diet is completely covered. Treated trays are placed under a constant airflow at ambient temperature until there is no visible liquid on the diet surface. A single larva is place into each well and the well is sealed using a ventilated lid designed specifically for use with the trays.

Treated trays containing insects are incubated under controlled environmental conditions (28° C., ~40% r.h., 16:8 [L:D]) for 5 days at which point the total number of insects in the treatment, the number of dead insects, and the weight of frozen surviving insects are recorded. Percent mortality and percent growth inhibition are calculated for each treatment. Growth inhibition is calculated as follows:

Growth Inhibition=[1−(Average Weight of Insects in Treatment/Average Weight of Insects in the Background Check)]

Example 3

Expression of Modified Cry Proteins in Plants

One aspect of the subject invention is the transformation of plants with genes encoding the insecticidal protein. The transformed plants are resistant to attack by the target pest.

Genes encoding modified Cry proteins, as disclosed herein, can be inserted into plant cells using a variety of techniques which are well known in the art. For example, a large number of cloning vectors comprising a replication system in *E. coli* and a marker that permits selection of the transformed cells are available for preparation for the insertion of foreign genes into higher plants. The vectors comprise, for example, pBR322, pUC series, M13mp series, pACYC184, etc. Accordingly, the sequence encoding the modified Cry protein can be inserted into the vector at a suitable restriction site. The resulting plasmid is used for transformation into *E. coli*. The *E. coli* cells are cultivated in a suitable nutrient medium, then harvested and lysed. The plasmid is recovered.

Sequence analysis, restriction analysis, electrophoresis, and other biochemical-molecular biological methods are generally carried out as methods of analysis. After each manipulation, the DNA sequence used can be cleaved and joined to the next DNA sequence. Each plasmid sequence can be cloned in the same or other plasmids. Depending on the method of inserting desired genes into the plant, other DNA sequences may be necessary. If, for example, the Ti or Ri plasmid is used for the transformation of the plant cell, then at least the right border, but often the right and the left border of the Ti or Ri plasmid T-DNA, has to be joined as the flanking region of the genes to be inserted.

The use of T-DNA for the transformation of plant cells has been intensively researched and sufficiently described in EP 120 516; Hoekema (1985) In: *The Binary Plant Vector System*, Offset-durkkerij Kanters B. V., Alblasserdam, Chapter 5; Fraley et al., *Crit. Rev. Plant Sci.* 4:1-46; and An et al. (1985) *EMBO J.* 4:277-287.

Once the inserted DNA has been integrated in the plant genome, it is relatively stable. The transformation vector normally contains a selectable marker that confers on the transformed plant cells resistance to a biocide or an antibiotic, such as bialophos, kanamycin, G 418, bleomycin, or hygromycin, inter alia. The individually employed marker should accordingly permit the selection of transformed cells rather than cells that do not contain the inserted DNA.

A large number of techniques are available for inserting DNA into a plant host cell. Those techniques include transformation with T-DNA using *Agrobacterium tumefaciens* or *Agrobacterium rhizogenes* as transformation agent, fusion, injection, biolistics (microparticle bombardment), or electroporation as well as other possible methods. If Agrobacteria are used for the transformation, the DNA to be inserted has to be cloned into special plasmids, namely either into an intermediate vector or into a binary vector. The intermediate vectors can be integrated into the Ti or Ri plasmid by homologous recombination owing to sequences that are homologous to sequences in the T-DNA. The Ti or Ri plasmid also comprises the vir region necessary for the transfer of the T-DNA. Intermediate vectors cannot replicate themselves in Agrobacteria. The intermediate vector can be transferred into *Agrobacterium tumefaciens* by means of a helper plasmid (conjugation). Binary vectors can replicate themselves both in *E. coli* and in Agrobacteria. They comprise a selection marker gene and a linker or polylinker which are framed by the right and left T-DNA border regions. They can be transformed directly into Agrobacteria (Holsters et al. [1978*] Mol. Gen. Genet.* 163:181-187).

The *Agrobacterium* used as host cell is to comprise a plasmid carrying a vir region. The vir region is necessary for the transfer of the T-DNA into the plant cell. Additional T-DNA may be contained. The bacterium so transformed is used for the transformation of plant cells. Plant explants can advantageously be cultivated with *Agrobacterium tumefaciens* or *Agrobacterium rhizogenes* for the transfer of the DNA into the plant cell. Whole plants can then be regenerated from the infected plant material (for example, pieces of leaf, segments of stalk, roots, but also protoplasts or suspension-cultivated cells) in a suitable medium, which may contain antibiotics or biocides for selection. The plants so obtained can then be tested for the presence of the inserted DNA. No special demands are made of the plasmids in the case of injection and electroporation. It is possible to use ordinary plasmids, such as, for example, pUC derivatives.

The transformed cells grow inside the plants in the usual manner. They can form germ cells and transmit the transformed trait(s) to progeny plants. Such plants can be grown in the normal manner and crossed with plants that have the same transformed hereditary factors or other hereditary factors. The resulting hybrid individuals have the corresponding phenotypic properties.

In a preferred embodiment of the subject invention, plants will be transformed with genes wherein the codon usage has been optimized for plants. See, for example, U.S. Pat. No. 5,380,831, which is hereby incorporated by reference. Methods for creating synthetic B.t. genes for use in plants are known in the art (Stewart 2007).

*Agrobacterium* Transformation

Standard cloning methods are used in the construction of binary plant expression plasmids. Restriction endonucleases are obtained from New England Biolabs and T4 DNA Ligase (New England Biolabs, Cat# M0202T) was used for DNA ligation. Plasmid preparations are performed using the Nucleospin Plasmid Preparation kit (Machery Nagel, Cat#740 588.250) or the Nucleobond AX Xtra Midi kit (Machery Nagel, Cat#740 410.100), following the instructions of the manufacturers. DNA fragments are purified using the QIAquick PCR Purification Kit (Qiagen, Cat#28104) or the QIAEX II Gel Extraction Kit (Qiagen, Cat#20021) after gel isolation.

DNA fragments are synthesized at DNA2.0 to create the modified Cry genes. Unique restriction sites internal to each gene are identified and a fragment of each gene was synthesized, each containing the specific deletion or insertion. The modified Cry fragments are subcloned into the full length genes at the BbsI restriction site at the start of the gene and a second internal restriction site specific for each gene.

The basic cloning strategy was to subclone full length and the modified Cry coding sequences (CDS) into pDAB8863 at the NcoI and SacI restriction sites. The resulting plasmids are subcloned into the binary plasmid, pDAB3776, utilizing Gateway® technology. LR Clonase™ (Invitrogen, Cat#11791-019) was used to recombine the full length and modified gene cassettes into the binary expression plasmid.

Electro-competent *Agrobacterium tumefaciens* (strain Z707S) cells are prepared and transformed using electroporation (Weigel and Glazebrook, 2002). 50 μl of competent agro cells are thawed on ice and 10-25 ng of the desired plasmid was added to the cells. The DNA and cell mix was added to pre-chilled electroporation cuvettes (2 mm). An Eppendorf Electroporator 2510 was used for the transformation with the following conditions, Voltage: 2.4 kV, Pulse length: 5 msec. After electroporation, 1 mL of YEP broth was added to the cuvette and the cell-YEP suspension was transferred to a 15 ml culture tube. The cells are incubated at 28° C. in a water bath with constant agitation for 4 hours. After incubation, the culture was plated on YEP+agar with erythromycin (200 mg/L) and streptomycin (Sigma Chemical Co., St. Louis, Mo.) (250 mg/L). The plates are incubated for 2-4 days at 28° C. Colonies are selected and streaked onto fresh YEP+agar with erythromycin (200 mg/L) and streptomycin (250 mg/L) plates and incubated at 28° C. for 1-3 days.

Colonies are selected for PCR analysis to verify the presence of the gene insert by using vector specific primers. Qiagen Spin Mini Preps, performed per manufacturer's instructions, are used to purify the plasmid DNA from selected *Agrobacterium* colonies with the following exception: 4 mL aliquots of a 15 mL overnight mini prep culture (liquid YEP+spectinomycin (200 mg/L) and streptomycin (250 mg/L)) are used for the DNA purification. Plasmid DNA from the binary vector used in the *Agrobacterium* transformation was included as a control. The PCR reaction was completed using Taq DNA polymerase from Invitrogen per manufacture's instructions at 0.5× concentrations. PCR reactions are carried out in a MJ Research Peltier Thermal Cycler programmed with the following conditions; 1) 94° C. for 3 minutes 2) 94° C. for 45 seconds 3) 55° C. for 30 seconds 4) 72° C. for 1 minute per kb of expected product length 5) 29 times to step 2 6) 72° C. for 10 minutes. The reaction was maintained at 4° C. after cycling. The amplification was analyzed by 1% agarose gel electrophoresis and visualized by ethidium bromide staining A colony was selected whose PCR product was identical to the plasmid control.

*Arabidopsis* Transformation

*Arabidopsis thaliana* Col-01 is transformed using the floral dip method. The selected colony was used to inoculate one or 15 mL culture of YEP broth containing appropriate antibiotics for selection. The culture is incubated overnight at 280 C with constant agitation at 220 rpm. Each culture is used to inoculate 2 500 ml cultures of YEP broth containing antibiotics for selection and the new cultures are incubated overnight at 280 C with constant agitation. The cells are then pelleted at approx. 8700×g for 10 minutes at room temperature, and the resulting supernatant discarded. The cell pellet is gently resuspended in 500 mL infiltration media containing: 1/2× Murashige and Skoog salts/Gamborg's B5 vitamins, 10% (w/v) sucrose, 0.044 μM benzylamino purine (10 μl/liter of 1 mg/ml stock in DMSO) and 300 μl/liter Silwet L-77. Plants approximately 1 month old are dipped into the media for 15 seconds, being sure to submerge the newest inflorescence. The plants are then laid down on their sides and covered (transparent or opaque) for 24 hours, washed with water, and placed upright. The plants are grown at 220 C, with a 16-hour light/8-hour dark photoperiod. Approximately 4 weeks after dipping, the seeds are harvested.

*Arabidopsis* Growth and Selection

Freshly harvested seed is allowed to dry for at least 7 days at room temperature in the presence of desiccant. Seed is suspended in a 0.1% Agar (Sigma Chemical Co., St. Louis, Mo.) solution. The suspended seed is stratified at 4° C. for 2 days. Sunshine Mix LP5 (Sun Gro Horticulture Inc., Bellevue, Wash.) is covered with fine vermiculite and subirrigated with Hoaglan's solution until wet. The soil mix is allowed to drain for 24 hours. Stratified seed is sown onto the vermiculite and covered with humidity domes (KORD Products, Bramalea, Ontario, Canada) for 7 days. Seeds are germinated and plants are grown in a Conviron (models CMP4030 and CMP3244, Controlled Environments Limited, Winnipeg, Manitoba, Canada) under long day conditions (16 hours light/8 hours dark) at a light intensity of 120-150 μmol/m2 sec under constant temperature (22° C.) and humidity (40-50%). Plants are initially watered with Hoagland's solution and subsequently with DI water to keep the soil moist but not wet.

T1 seed is sown on 10.5"×21" germination trays (T.O. Plastics Inc., Clearwater, Minn.) as described and grown under the conditions outlined. The domes are removed 5-6 days post sowing and plants are sprayed with a 1000× solution of Finale (5.78% glufosinate ammonium, Farnam Companies Inc., Phoenix, Ariz.). Two subsequent sprays are performed at 5-7 day intervals. Survivors (plants actively growing) are identified 7-10 after the final spraying and transplanted into pots prepared with Sunshine mix LP5. Transplanted plants are covered with a humidity dome for 3-4 days and placed in a Conviron with the above mentioned growth conditions.

Example 4

Protein Extraction and Detection

Plant tissue is harvested and immediately frozen in liquid nitrogen or on dry ice and stored at −80° C. in a plastic freezer bag. Upon extraction the sample in the bag is removed from the freezer and placed into liquid nitrogen. The tissue is disrupted by rolling a glass rod across the bag. The tissue is then placed into a tissue homogenizer and homogenization buffer is added (50 mM Tris, buffer, pH 7.8, containing 1 mM DTT, 1 mM EDTA, 1 mM Benzamidine, 0.1% Na Metabisulfate, and 1× plant protease inhibitor cocktail (Sigma)) at a rate of 2 ml buffer/gram of tissue. The tissue is ground well in the homogenizer keeping the unit on wet ice. The sample is placed in a polypropylene centrifuge tube and centrifuged at 14,0000× gravity for 20 minutes at 4° C. The supernatant and pellet are separated and represent both soluble and insoluble fractions respectively. The fractions are then analyzed for recombinant protein as described below.

Proteins are electrotransferred to Nitrocellulose membranes (Amersham Biosciences), which are then blocked with 5% powdered milk in phosphate-buffered saline and 0.05% Tween 20 (Sigma) for 1 h and then incubated with anti-SUP antibody 1:3000 diluted in 3% milk, phosphate-buffered saline, and 0.05% Tween 20. Blots are subsequently incubated with horseradish peroxidase-conjugated secondary antibodies (goat anti-rabbit (Amersham Biosciences) and the signal is detected by ECL™ (Amersham Biosciences).

Example 5

Insect Bioassays of Transgenic *Arabidopsis*

Transgenic *Arabidopsis* lines expressing modified Cry proteins listed as SEQ ID NO. 1 through 436 are demonstrated to be active against sensitive rootworm species, including WCR and SCR, in artificial diet overlay assays. Non-transgenic *Arabidopsis* and/or buffer and water are included in assays as background check treatments.

Protein is extracted from transgenic and non-transgenic *Arabidopsis* lines using the following procedure. All available rosette leaf tissue from 7-8 week old *Arabidopsis* T2 plants carrying the modified Cry transgene are harvested into 15 ml conical tubes and frozen on dry ice. Stainless steel balls (3/16", Small Parts Inc., Miami Lakes, Fla.) are added to each tube and tissue is ground to a fine powder by vortexing. Two ml of extraction buffer (50 mM $KPO_4$, 10 mM dithiothreitol) is added to each tube and the tubes are vortexed for 2 min and kept on ice. Samples are centrifuged at 2750×g and the supernatants are transferred to fresh tubes. Total protein is quantified by Bradford method (REF) and sample volumes are adjusted to normalize protein concentration.

Bioassays are conducted on artificial diet in 128-well trays specifically designed for insect bioassays (Bio-Serv, Frenchtown, N.J.). Samples are pipetted into each well so that the surface of the diet is completely covered. Treated trays are placed under a constant airflow at ambient temperature until there is no visible liquid on the diet surface. A single larva is placed into each well, and the well is sealed using a ventilated lid designed specifically for use with the trays.

Treated trays containing insects are incubated under controlled environmental conditions (28° C., ~40% r.h., 16:8 [L:D]) for 5 days at which point the total number of insects in the treatment, the number of dead insects, and the weight of frozen surviving insects are recorded. Percent mortality and percent growth inhibition are calculated for each treatment. Growth inhibition is calculated as follows:

% Growth Inhibition=[1−(Average Weight of Insects in Treatment/Average Weight of Insects in the Background Check)]

Example 6

*Agrobacterium*-Mediated Transformation of Maize

*Agrobacterium* Transformation for Generation of Superbinary Vectors

To prepare for transformation, two different *E. coli* strains (DH5a containing the pSB11 precursor {either pDAB7702 or pDAB3878 in this case} or pRK2013) are grown at 37° Celsius overnight. The DH5α strain is grown on a petri plate containing LB (5 g Bacto Tryptone, 2.5 g Bacto Yeast Extract, 5 g NaCl, 7.5 g Agar, in 500 ml DI $H_2O$)+Spectinomycin (100 μg/ml) and the pRK2013 strain is grown on a petri plate containing LB+Kanamycin (50 μg/ml). After incubation the plates are placed at 4° Celsius to await the availability of the *Agrobacterium* strain. *Agrobacterium* strain LBA4404 containing pSB1 (Japan Tobacco) is grown on AB medium (5 g Glucose, 15 g Agar, in 900 ml DI $H_2O$) with Streptomycin (250 n/ml) and Tetracycline (10 μg/ml) at 28° Celsius for 3 days. After the *Agrobacterium* is ready, transformation plates are set up by mixing one inoculating loop of each bacteria (pDAB7702 or pDAB3878, pRK2013, and LBA4404+pSB1) on a LB plate with no antibiotics. This plate is incubated at 28° Celsius overnight.

After incubation 1 ml of 0.9% NaCl (4.5 g NaCl in 500 ml DI $H_2O$) solution is added to the mating plate and the cells are mixed into the solution. The mixture is then transferred into a labeled sterile Falcon 2059 (Becton Dickinson and Co. Franklin Lakes, N.J.) tube or equivalent. Another ml of 0.9% NaCl is added to the plate and the remaining cells are mixed into the solution. This mixture is then transferred to the same labeled tube as above. Serial dilutions of the bacterial cells are made ranging from $10^1$-$10^4$ by placing 100 μl of the bacterial "stock" culture into labeled Falcon 2059 (Becton Dickinson and Co. Franklin Lakes, N.J.) tubes and then adding 900 μl of 0.9% NaCl. To ensure selection, 100 μl of the dilutions are then plated onto separate AB+Spectinomycin (100 μg/ml)/Sterpromycin (250 μg/ml)/Tetracycline (10 μg/ml) and incubated at 28° Celsius for 4 days.

The colonies are then "patched" onto AB+Spec/Strep/Tet plates as well as lactose medium (0.5 g Yeast Extract, 5 g D-lactose monohydrate, 7.5 g Agar, in 500 ml DI $H_2O$)

plates and placed in the incubator at 28° Celsius for 2 days. A Keto-lactose test is performed on the colonies on the lactose media by flooding the plate with Benedict's solution (86.5 g Sodium Citrate monobasic, 50 g $Na_2CO_3$, 9 g $CuSO_4$-5H2O, in 500 ml of DI $H_2O$) and allowing the agro colonies to turn yellow.

Any colonies that are yellow (positive for *Agrobacterium*) are then picked from the patch plate and streaked for single colony isolation on AB+Spec/Strep/Tet plates at 28° Celsius for 2 days. One colony per plate is picked for a second round of single colony isolations on AB+Spec/Strep/Tet media and this is repeated for a total of three rounds of single colony isolations. After the isolations, one colony per plate is picked and used to inoculate separate 3 ml YEP (5 g Yeast Extract, 5 g Peptone, 2.5 g NaCl, in 500 ml DI $H_2O$) liquid cultures containing Spectinomycin (100 µg/ml), Streptomycin (250 µg/ml), and Tetracycline (10 µg/ml). These liquid cultures are then grown overnight at 28° Celsius in a drum incubator at 200 rpm.

Validation cultures are then stated by transferring 2 ml of the inoculation cultures to 250 ml disposable flasks containing 75 ml of YEP+Spec/Strep/Tet. These are then grown overnight at 28° Celsius while shaking at 200 rpm. Following the Qiagen® protocol, Hi-Speed maxi-preps (Qiagen Valencia, Calif.) are then performed on the bacterial cultures to produce plasmid DNA. 500 µl of the eluted DNA is then transferred to 2 clean, labeled 1.5 ml tubes and the Edge BioSystems (Gaithersburg, Md.) Quick-Precip Plus® protocol was followed.

After the precipitation the DNA is resuspended in a total volume of 100 µl TE (10 mM Tris HCl, pH 8.0; 1 mM EDTA). 5 µl of plasmid DNA is added to 50 µl of chemically competent DH5a (Invitrogen; Carlsbad, Calif.) *E. coli* cells and gently mixed. This mixture is then transferred to chilled and labeled Falcon 2059 (Becton Dickinson and Co. Franklin Lakes, N.J.) tubes. The reaction is incubated on ice for 30 minutes and then heat shocked at 42° Celsius for 45 seconds. The reaction is placed back into the ice for 2 minutes and then 450 µl of SOC medium (Invitrogen; Carlsbad, Calif.) is added to the tubes. The reaction is then incubated at 37° Celsius for 1 hour, shaking at 200 rpm. The cells are then plated onto LB+Spec/Strep/Tet (using 50 µl and 100 µl) and incubated at 37° Celsius overnight.

Three or Four colonies per plate are picked and used to inoculate separate 3 ml LB (5 g Bacto Tryptone, 2.5 g Bacto Yeast Extract, 5 g NaCl, in 500 ml DI $H_2O$) liquid cultures containing Spectinomycin (100 µg/ml), Streptomycin (250 µg/ml), and Tetracycline (10 µg/ml). These liquid cultures are then grown overnight at 37° Celsius in a drum incubator at 200 rpm. Following the Qiagen® protocol, mini-preps (Qiagen Valencia, Calif.) are then performed on the bacterial cultures to produce plasmid DNA. 5 µl of plasmid DNA is then digested in separate reactions using HindIII and SalI enzymes (New England Biolabs Beverly, Mass.) at 37° Celsius for 1 hour before being ran on a 1% agarose (Cambrex Bio science Rockland, Inc. Rockland, Me.) gel. The culture that showed the correct banding pattern is then used to create glycerol stocks by adding 500 µl of culture to 500 µl of sterile glycerol (Sigma Chemical Co.; St. Louis, Mo.) and inverting to mix. The mixture is then frozen on dry ice and stored at −80° Celsius until needed.

*Agrobacterium*-Mediated Transformation of Maize

Seeds from a High II $F_1$ cross (Armstrong et al., 1991) are planted into 5-gallon-pots containing a mixture of 95% Metro-Mix 360 soilless growing medium (Sun Gro Horticulture, Bellevue, Wash.) and 5% clay/loam soil. The plants are grown in a greenhouse using a combination of high pressure sodium and metal halide lamps with a 16:8 hour photoperiod. For obtaining immature $F_2$ embryos for transformation, controlled sib-pollinations are performed. Immature embryos are isolated at 8-10 days post-pollination when embryos are approximately 1.0 to 2.0 mm in size.

Infection and Cocultivation

Maize ears are surface sterilized by scrubbing with liquid soap, immersing in 70% ethanol for 2 minutes, and then immersing in 20% commercial bleach (0.1% sodium hypochlorite) for 30 minutes before being rinsed with sterile water. The *Agrobacterium* suspension is prepared by transferring 1-2 loops of bacteria grown on YEP medium (40 g/L peptone, 40 g/L yeast extract, 20 g/L NaCl, 15 g/L Bacto agar) containing 100 mg/L spectinomycin, 10 mg/L tetracycline, and 250 mg/L streptomycin at 28 C for 2-3 days into 5 mL of liquid infection medium (LS Basal Medium (Linsmaier and Skoog, 1965), N6 vitamins (Chu et al, 1965), 1.5 mg/L 2,4-D, 68.5 g/L sucrose, 36.0 g/L glucose, 6 mM L-proline, pH 5.2) containing 100 uM acetosyringone. The solution is vortexed until a uniform suspension is achieved, and the concentration is adjusted to a final density of 200 Klett units, using a Klett-Summerson colorimeter with a purple filter. Immature embryos are isolated directly into a micro centrifuge tube containing 2 mL of the infection medium. The medium is removed and replaced with 1 mL of the *Agrobacterium* solution with a density of 200 Klett units. The *Agrobacterium* and embryo solution is incubated for 5 minutes at room temperature and then transferred to co-cultivation medium (LS Basal Medium, N6 vitamins, 1.5 mg/L 2,4-D, 30.0 g/L sucrose, 6 mM L-proline, 0.85 mg/L $AgNO_3$,1, 100 µM acetosyringone, 3.0 g/L Gellan gum, pH 5.8) for 5 days at 25° C. under dark conditions.

After co-cultivation, the embryos are transferred to selective media after which transformed isolates are obtained over the course of approximately 8 weeks. For selection, an LS based medium (LS Basal medium, N6 vitamins, 1.5 mg/L 2,4-D, 0.5 g/L MES, 30.0 g/L sucrose, 6 mM L-proline, 1.0 mg/L $AgNO_3$, 250 mg/L cephotaxime, 2.5 g/L Gellan gum, pH 5.7) is used with Bialaphos. The embryos are transferred to selection media containing 3 mg/liter Bialaphos until embryogenic isolates are obtained. Any recovered isolates are bulked up by transferring to fresh selection medium at 2-week intervals for regeneration and further analysis.

Regeneration and Seed Production

For regeneration, the cultures are transferred to "28" induction medium (MS salts and vitamins, 30 g/L sucrose, 5 mg/L benzylaminopurine, 0.25 mg/L 2, 4-D, 3 mg/liter Bialaphos, 250 mg/L cephotaxime, 2.5 g/L Gellan gum, pH 5.7) for 1 week under low-light conditions (14 µE/m²/s) then 1 week under high-light conditions (approximately 89 µE/m²/s). Tissues are subsequently transferred to "36" regeneration medium (same as induction medium except lacking plant growth regulators). When plantlets grew to 3-5 cm in length, they are transferred to glass culture tubes containing SHGA medium (Schenk and Hildebrandt salts and vitamins (1972), 1.0 g/L myo-inositol, 10 g/L sucrose and 2.0 g/L Gellan gum, pH 5.8) to allow for further growth and development of the shoot and roots. Plants are transplanted to the same soil mixture as described earlier herein and grown to flowering in the greenhouse. Controlled pollinations for seed production are conducted.

Example 7

Bioassay of to Transgenic Maize

WCR eggs are received in soil from Crop Characteristics (Farmington, Minn.). WCR eggs are incubated at 28 C for approximately 10-11 days. Eggs are placed into 0.15% agar solution until the concentration is approximately 75-100 eggs per 0.25 mL aliquot. A hatch plate is set up in a Petri dish with an aliquot of egg suspension on moistened filter paper and sealed with Parafilm. The hatch plate is checked daily for the emergence of WCR larvae. The grade date for the test is 2 weeks after larval hatch.

The soil around the plants is infested with approximately 150-200 WCR eggs, for an estimate of 50-120 larvae per plant during testing. The insects are allowed to feed for 2 weeks, after which a Root Rating is given to each plant. The Node-Injury Scale developed by Oleson, et al. 2005 is utilized for grading, although only scores from 0.01 to 1.0 are given. See Table 2 for a detailed listing of the root ratings and amount of damage caused by the rootworms. The root material is disturbed as little as possible and soil is not washed completely from the plant, so the entire 3-point scale is not used.

Plants which pass the bioassay (with a root rating of 0.5 or less) are transplanted immediately for seed production, and seeds produced by these plants are saved for evaluation as the T1 generation of plants.

Statistical analysis is conducted using JMP software. Protein expression (ng/mL of Cry protein) values are transformed using a natural log transformation.
TABLE 2: Summary of Node-Injury Rating System (Oleson, et al, 2005)
0.01 No damage or only a few minor feedings
0.02 Feeding scars evident, but no roots eaten off to within 4 cm of stalk (a root eaten to within 4 cm of the stalk is considered a "pruned root)
0.10 Many noticeable feeding scars on the outer portion of root, but no root pruning
0.25 One to three roots pruned, But less than an entire node pruned; outer roots with a moderate amount of feeding damage
0.50 4-5 roots pruned, considerable feeding damage on the outer portion of the root system
0.075 6+roots pruned, but with extensive feeding on outer portion of the root system 1.00, 1.25, 1.5, etc.
At least one full node of roots pruned, but fewer than two full nodes pruned 2.00, 2.25, etc.
At least two full nodes of roots pruned, but less than three full nodes pruned
3.00 Three or more full nodes of roots pruned Example 8

Construction of Dig-230 Toxin Variants with Protease Sites Engineered within Domain 1

Activity of Cry proteins may be modified by genetic deletion of various structural elements with Domain 1; including Helix 1, Helix 2A and the associated inter-helices loops. Such modifications may impart specific qualities to the engineered toxins which make them desirable over other toxins. Some of these qualities may include activity against Cry-toxin resistant insects, activity against a broader spectrum of insects, and/or increased protein activity, stability or accumulation in transgenic plants. Modification of structural elements within the toxin may be accomplished by means other than by genetic deletion. One alternate method involves the precise mutation of selected amino acid residues within Helix 1, such mutations designed specifically to destabilize the helical structure and increase its processing. Yet another approach by means of which one may modify Domain 1 structural elements is through the inclusion of protease sensitive sites at specific locations intended to enhance processing of the structural elements. In some embodiments it may be desirable to combine these methods.

In this Example, genes encoding variant Cry toxins with improved or broadened activity against certain classes of insects were designed. The variants comprise insertion of sequences encoding protease sensitive sequences into the 5' end of the DIG-230 coding sequence, with the objective being to affect the removal of Helix1 and Helix2A, and the associated loops, from otherwise wild-type proteins. In one embodiment, protease sites were introduced into the loop region between Helix1 and Helix2A. In a second embodiment, protease sites were introduced into the loop region between Helix1 and Helix2A, and amino acid substitutions were made to destabilize Helix1. In a third embodiment, protease sites were introduced into the loop region between Helix2A and Helix2B. This example discloses such protease site variants of SEQ ID NO: 441, which presents a DNA sequence that encodes a Cry3B-class protein toxin herein referred to as DIG-230. SEQ ID NO: 442 presents the amino acid sequence of the DIG-230 protein encoded by SEQ ID NO: 441. The DIG-230 protein is highly related to the unnamed protein of GenBank Accession No. CAA34983.

Design of Deletion Variants.

We have deduced the likely beginnings and ends of the 3-dimensional structures corresponding to Helix1, Helix2A, and Helix2B, and the locations of the intervening loop regions between them, in Domain 1 of the DIG-230 toxin. These features were predicted by comparing the amino acid sequence of the DIG-230 protein of SEQ ID NO: 442 with the amino acid sequence of a Cry3Bb protein (UniProtKB/Swiss-Prot Accession Number Q06117), for which the crystal structure is known and published (RCSB Protein Structure Database Number 1JI6; and Galitsky et al, (2001)). The homology alignments were conducted using the Jalview 2.3 program (Clamp et al., 2004). The predicted structure locations (Table 3) were used to design the locations of the protease insertion sites of the novel proteins of this invention.

TABLE 3

Amino acid coordinates of projected α-helices of DIG-230 core toxin Domain 1.

| | Helix1 | spacer | Helix2A | spacer | Helix2B |
|---|---|---|---|---|---|
| Residues of SEQ ID NO: 442 | 65-80 | 81-90 | 91-99 | 100-104 | 105-112 |

One skilled in the field of protein engineering will recognize the dual importance of preserving the accessibility of an engineered protease site and the maintenance of required adjacent protein structural features. The specific protease site sequences employed in this example were derived from corn rootworm gut protease sensitive regions of other Cry toxins, with variations tested to alter charge and structure with the intent of increasing processing. Thus, we tested protease-sensitive sites five or seven residues long, with the object of discovering protease site compositions that would preserve the essential protein structural features of DIG-230 protein Domain 1. In some instances introduction of the engineered protease site was accompanied by the introduction of a helix-destabilizing amino acid at a position distant from the protease insertion site.

Eight protease sensitive sequences were engineered into the loop region between Helix1 and Helix2A by replacing residues 83 to 87 of SEQ ID NO: 442. In addition, amino acid substitutions at two positions were engineered in combination with one of the protease sensitive sequence insertions between Helix1 and Helix2A. Further, two protease sensitive sequences were introduced into the loop region between Helix2A and Helix2B by replacing residues 102-104 of SEQ ID NO: 442. (Deduced co-ordinates of the helices and spacers are presented in Table 3). The insertion positions of the engineered sites and their coordinates in the respective DIG proteins are listed along with the associated SEQ ID Numbers in Table 4. Also disclosed are the amino acid substitutions. All of the introduced sequence changes are intended to increase proteolytic processing within Domain 1 of the engineered protein and to thereby increase insect toxin activity. Processing at the engineered sites may occur within a transgenic plant or within the insect gut. In either or both cases, the effectiveness of the engineered protein toxin will be one of increased activity. Further, such an engineered protein may be inherently toxic to a broader spectrum of insect species than is exhibited by the wild type toxin from which it is derived.

TABLE 4

Protease insertion sites of DIG-230 protease variants. SEQ ID Numbers associated with each protease variant (both DNA coding sequence and encoded protein) are listed. Protease Site Residues are those of the corresponding protein SEQ ID NO. for each DIG protein.

| DIG Number | Insertion Location | DIG-230 Insertion Position[a] | DIG-230 Deleted Residues | SEQ ID NO: (DNA) | SEQ ID NO: (Protein) | Protease Site Residues |
|---|---|---|---|---|---|---|
| DIG-52 | Between Helix1 and Helix2A | 82 | 83-87 | 443 | 444 | 83-89 |
| DIG-53 | Between Helix1 and Helix2A | 82 | 83-87 | 445 | 446 | 83-89 |
| DIG-54 | Between Helix1 and Helix2A | 82 | 83-87 | 447 | 448 | 83-89 |
| DIG-55 | Between Helix1 and Helix2A | 82 | 83-87 | 449 | 450 | 83-89 |
| DIG-56 | Between Helix1 and Helix2A | 82 | 83-87 | 451 | 452 | 83-89 |
| DIG-57 | Between Helix1 and Helix2A | 82 | 83-87[b] | 453 | 454 | 83-89 |
| DIG-58 | Between Helix1 and Helix2A | 82 | 83-87[c] | 455 | 456 | 83-89 |
| DIG-99 | Between Helix1 and Helix2A | 82 | 83-87[d] | 457 | 458 | 83-89 |
| DIG-59 | Between Helix2A and Helix2B | 101 | 102-104 | 459 | 460 | 102-106 |
| DIG-60 | Between Helix2A and Helix2B | 101 | 102-104 | 461 | 462 | 102-106 |

[a]Protease sensitive site was engineered immediately after the listed amino acid position of the DIG-230 sequence disclosed in SEQ ID NO: 442.
[b]Residue 70 (I) of SEQ ID NO: 442 replaced with D
[c]Residue 74 (G) of SEQ ID NO: 442 replaced with D
[d]Residues 70 (I) and 74 (G) of SEQ ID NO: 442 both replaced with D The coding sequences for proteins DIG-52 through DIG-60, DIG-99, and DIG-230 are inserted into the *Pseudomonas* expression vector pDOW1169 (WO/2008/151319) and expressed as described below.

Example 9

Construction of Expression Plasmids Encoding Dig-Proteins and Expression in Bacterial Hosts Construction of Expression Vectors.

Standard cloning methods as taught in Sambrook et al. (1989) and Ausubel et al. (1995) are used in the construction of *Pseudomonas fluorescens* (Pf) expression plasmids engineered to produce the DIG-52, DIG-53, DIG-54, DIG-55, DIG-56, DIG-57, DIG-58, DIG-59, DIG-60, DIG-99, or DIG-230 proteins. Restriction endonucleases are obtained from NEB and T4 DNA Ligase (Invitrogen) is used for DNA ligation. Plasmid preparations are performed using the NucleoBond® Xtra Kit (Macherey-Nagel Inc, Bethlehem, Pa.) or the Plasmid Midi Kit (Qiagen), following the instructions of the suppliers. DNA fragments are purified using the Millipore Ultrafree®-DA cartridge (Billerica, Mass.) after agarose Tris-acetate gel electrophoresis.

The basic cloning strategy consists of subcloning a DIG coding sequence into pDOW1169 with SpeI and XhoI restriction sites, whereby it is placed under the expression control of the Ptac promoter and the rrnBT1T2 terminator from plasmid pKK223-3 (PL Pharmacia, Milwaukee, Wis.). It is understood, however, that other vectors may be used. pDOW1169 is a medium copy plasmid with the RSF1010 origin of replication, a pyrF gene, and a ribosome binding site preceding the restriction enzyme recognition sites into which DNA fragments containing protein coding regions may be introduced, (US Patent Application No. 20080193974). The expression plasmid is transformed by electroporation into DC454 (a near wild-type *P. fluorescens* strain having mutations ΔpyrF and lsc::lacI$^{QI}$), or its derivatives, recovered in SOC-Soy hydrolysate medium, and plated on selective medium (M9 glucose agar lacking uracil, Sambrook et al., supra). Details of the microbiological manipulations are available in Squires et al., (2004), and in US Patent Application No. 20060008877, US Patent Application No. 20080193974, and US Patent Application No. 20080058262, incorporated herein by reference. Colonies are screened by restriction digestion of miniprep plasmid DNA. Plasmid DNA of selected clones containing inserts is sequenced by a commercial sequencing vendor such as Eurofin MWG Operon (Huntsville, Ala.). Sequence data are assembled and analyzed using the Sequencher™ software (Gene Codes Corp., Ann Arbor, Mich.).

Growth and Expression Analysis in Shake Flasks.

Production of DIG toxins for characterization and insect bioassay is accomplished by shake-flask-grown *P. fluorescens* strains harboring expression constructs. Seed cultures grown in M9 medium supplemented with 1% glucose and trace elements are used to inoculate 50 mL of defined minimal medium with 5% glycerol (Teknova Cat. #3D7426, Hollister, Calif.). Expression of the DIG toxin gene via the Ptac promoter is induced by addition of isopropyl-β-D-1-thiogalactopyranoside (IPTG) after an initial incubation of 24 hours at 30° C. with shaking. Cultures are sampled at the time of induction and at various times post-induction. Cell density is measured by optical density at 600 nm (OD$_{600}$). One skilled in the field of *Pseudomonas* gene expression will understand that other culture media suitable for growth of *Pseudomonas fluorescens* may also be utilized, for example, as described in Huang et al., 2007 and US Patent Application No. 20060008877.

Cell Fractionation and SDS-PAGE Analysis of Shake Flask Samples.

At each sampling time, 2 mL aliquots are centrifuged at 14000×g for two minutes. The cell pellets are frozen at −20° C. Soluble and insoluble fractions from frozen shake flask cell pellet samples are generated for analysis. The cell pellet is resuspended in 1 mL of phosphate buffer (Fisher Scientific Catalog #02-686-201A 0.3 mM Phosphate pH7) and transferred to a 15 mL conical screw cap centrifuge tube. The cells are cooled on ice and lysed by sonication with a 2 mm tip and a Branson 250 sonicator using 2 bursts of 45 seconds each at an output of 20 using the constant duty cycle. The lysate is transferred to a 1.5 mL microfuge tube and centrifuged at 14,000 rpm for 10 minutes using a table top microcentrifuge. The supernatant fraction is removed and represents the soluble or supernatant fraction. The pellet is suspended in 0.5 mL of phosphate buffer and represents the pellet or insoluble fraction. The protein concentrations of the fractions are determined using BioRad Protein Dye Assay Reagent. Samples are diluted appropriately and mixed with 4× Laemmli sample buffer containing β-mercaptoethanol (Sambrook et al., supra) and boiled for 5 minutes prior to loading onto Criterion XT Bis-Tris 12% gels (Bio-Rad Inc., Hercules, Calif.) Electrophoresis is performed in the recommended XT MOPS buffer. Gels are stained with Bio-Safe Coomassie Stain according to the manufacturer's (Bio-Rad) protocol and imaged using the Alpha Innotech Imaging system (San Leandro, Calif.).

Inclusion Body Preparation.

Cry protein inclusion body (IB) preparations are prepared from P. fluorescens cells that produce insoluble DIG protein. Cell pellets are thawed in a 37° C. water bath. The cells are adjusted to 25% w/v in lysis buffer (50 mM Tris, pH 7.5, 200 mM NaCl, 20 mM EDTA disodium salt, 1% Triton X-100, and 5 mM Dithiothreitol (DTT), 5 mL/L of bacterial protease inhibitor cocktail (P8465 Sigma Chemicals, St. Louis, Mo.) are added just prior to use). The cells are suspended using a hand-held homogenizer at lowest setting (Tissue Tearor, BioSpec Products, Inc Bartlesville, Okla.). Lysozme is added to the cell suspension (Sigma L7651, from chicken egg white), mixed with a metal spatula, and incubated at room temperature for one hour. After incubation, the suspension is cooled on ice for 15 minutes and sonicated using a Branson Sonifier 250 (two 1-minute sessions, at 50% duty cycle, 30% output), then checked for cell lysis by microscopy. Additional lysozyme is added and the sonication is repeated until cell lysis is confirmed via microscopy. The lysate is centrifuged at 11,500×g for 25 minutes to form the IB pellet. The supernatant is discarded and the IB pellet is resuspended in 100 mL of lysis buffer, homogenized with the hand-held mixer, and centrifuged again. The IB pellet is washed again by resuspension (in 50 mL lysis buffer), homogenization, sonication, and centrifugation until the supernatant becomes colorless and the IB pellet becomes firm and off-white in color. The final pellet is suspended in a sterile solution of 2 mM EDTA and stored at −80° C. in 1 mL aliquots.

Solubilization and Fractionation of IBs.

Two hundred fifty mg of IBs are thawed and centrifuged, the storage buffer is removed, and the pellets are suspended in 1 mL of 0.5M CAPS pH11 and transferred to a 15 mL centrifuge tube. Urea (3.6 gm) is added to the IB suspension and the solution is rocked gently to dissolve the pellet, then 25 mg of DTT, 50 mg of benzamidine and 200 μL of 0.5M EDTA are added. Water is added to adjust the final volume to 10 mL. The tube is kept in a 37° C. incubator and shaken vigorously at 250 rpm for 1 hr, then is left at room temperature overnight. Insoluble material is spun down and the solution is filtered through a 0.45 μM filter and loaded onto a Superose 6 column (GE Healthcare Life Sciences). The column is run at 0.7 mL/min using 25 mM CAPS pH11 containing 0.3M NaCl and 4M urea as the mobile phase. Fractions are collected and pooled on the basis of toxin aggregate size, and the urea in the pooled fractions is removed either by repeated passage through Amicon ultrafiltration units with a 10-30 kDa size cutoff (Millipore) or by dialyzing against 10 mM CAPS pH11.

REFERENCES

An, G.; Watson, B. D.; Stachel, S.; Gordon, M. P.; Nester, E. W. 1985. New cloning vehicles for transformation of higher plants. EMBO Journal 4(2), 277-84.

Armstrong, C. L., Green, C. E., and Phillips, R. L. (1991) Development and availability of germplasm with high Type II culture formation response. Maize Coop. News Lett. 65:92-93.

Ausubel et al., eds. (1995) *Current Protocols in Molecular Biology* (Greene Publishing and Wiley-Interscience, New York).

Carroll, J.; Convents, D.; Van Damme, J.; Boets, A.; Van Rie, J.; Ellar, D. J. 1997. Intramolecular proteolytic cleavage of *Bacillus thuringiensis* Cry3A-endotoxin may facilitate its coleopteran toxicity. Journal of Invertebrate Pathology 70(1), 41-49.

Bown, D. P., Wilkinson, H. S., Jongsma, M. A. and Gatehouse, J. A., 2004. Characterisation of cysteine proteinases responsible for digestive proteolysis in guts of larval western corn rootworm (*Diabrotica virgifera*) by expression in the yeast *Pichia pastoris*. Insect Biochem Mol Bio, 34: 305-320.

Bravo, Alejandra; Gill, Sarjeet S.; Soberon, Mario. 2007. Mode of action of *Bacillus thuringiensis* Cry and Cyt toxins and their potential for insect control. Toxicon 49(4), 423-435.

Caruthers, M. H.; Kierzek, R.; Tang, J. Y. 1987. Synthesis of oligonucleotides using the phosphoramidite method. Bioactive Molecules 3 (Biophosphates Their Analogues), 3-21.

Chu, C. C., Wang, C. C., Sun, C. S., Hsu, C., Yin, K. C., Chu, C. Y., and Bi, F. Y. (1975) Establishment of an efficient medium for anther culture of rice through comparative experiments on the nitrogen sources. Sci. Sinica 18:659-668.

Clamp, M., Cuff, J., Searle, S. M., Barton, G. J. (2004) The Jalview Java Alignment Editor. Bioinformatics 20:426-427.

Crickmore N, Zeigler D R, Feitelson J, Schnepf E, Van Rie J, Lereclus D, Baum J, Dean D H. 1998. Revision of the nomenclature for the *Bacillus thuringiensis* pesticidal c rystalproteins. Microbiol Mol Biol Rev. 62(3):807-13.

Diaz-Mendoza Mercedes; Farinos Gema P; Castanera Pedro; Hernandez-Crespo Pedro; Ortego Felix. 2007. Proteolytic processing of native Cry1Ab toxin by midgut extracts and purified trypsins from the Mediterranean corn borer Sesamia nonagrioides. Journal of insect physiology 53(5), 428-35.

Ellis, R. Tracy; Stockhoff, Brian A.; Stamp, Lisa; Schnepf, H. Ernest; Schwab, George E.; Knuth, Mark; Russell, Josh; Cardineau, Guy A.; Narva, Kenneth E. 2002. Novel *Bacillus thuringiensis* binary insecticidal crystal proteins active on western corn rootworm, *Diabrotica virgifera virgifera* LeConte. Applied and Environmental Microbiology (2002), 68(3), 1137-1145.

Fraley, Robert T.; Rogers, Stephen G.; Horsch, Robert B. 1986. Genetic transformation in higher plants. Critical Reviews in Plant Sciences 4(1), 1-46

Galitsky, N., Cody, V., Wojtczak, A., Ghosh, D., Luft, J. R., Pangborn, W., English, L. (2001) Structure of the insecticidal bacterial delta-endotoxin Cry3Bb1 of *Bacillus thuringiensis*. Acta Crystallogr., Sect. D 57:1101-1109.

Gazit, Ehud; La Rocca, Paolo; Sansom, Mark S. P.; Shai, Yechiel. 1998. Proceedings of the National Academy of Sciences of the United States of America 95(21), 12289-12294.

Gomez, Isabel; Sanchez, Jorge; Miranda, Raul; Bravo, Alejandra; Soberon, Mario. 2002. Cadherin-like receptor binding facilitates proteolytic cleavage of helix? −1 in domain I and oligomer pre-pore formation of *Bacillus thuringiensis* Cry1 Ab toxin. FEBS Letters 513(2,3), 242-246.

Grochulski, Pawel; Masson, Luke; Borisova, Svetlana; Pusztai-Carey, Marianne; Schwartz, Jean-Louis; Brousseau, Roland; Cygler, Miroslaw. 1995. *Bacillus thuringiensis* CryIA(a) insecticidal toxin: Crystal structure and channel formation. Journal of Molecular Biology (1995), 254(3), 447-64.

Herrnstadt, C and E. Wilcox. 1988. Cloning and expression of *Bacillus thuringiensis* toxin gene encoding a protein toxic to beetles of the order Coleoptera. U.S. Pat. No. 4,771,131

Hoekema (1985) In: The Binary Plant Vector System, Offset-durkkerij Kanters B. V., Alblasserdam, Chapter 5.

Holsters, M.; De Waele, D.; Depicker, A.; Messens, E.; Van Montagu, M.; Schell, J. 1978. Transfection and transformation of *Agrobacterium tumefaciens*. Molecular and General Genetics 163(2), 181-7.

Horton R M; Hunt H D; Ho S N; Pullen J K; Pease L R. 1989. Engineering hybrid genes without the use of restriction enzymes: gene splicing by overlap extension. Gene (1989), 77(1), 61-8.

Huang, K-X., Badger, M., Haney, K., and S. L. Evans (2007) Large scale production of *Bacillus thuringiensis* PS149B1 insecticidal proteins Cry34Ab1 and Cry35Ab1 from *Pseudomonas fluorescens*. Prot. Express. Purific. 53:325-330.

Janmaat A F; Myers J H 2007. Host-plant effects the expression of resistance to *Bacillus thuringiensis* kurstaki in *Trichoplusia ni* (Hubner): an important factor in resistance evolution. Journal of evolutionary biology 20(1), 62-9.

Jimenez-Juarez, N.; Munoz-Garay, C.; Gomez, I.; Gill, S. S.; Soberon, M.; Bravo, A. 2008. The pre-pore from *Bacillus thuringiensis* Cry1Ab toxin is necessary to induce insect death in *Manduca sexta*. Peptides 29(2), 318-323.

Knowles, B. H., and D. J. Ellar. 1987. Colloid-osmotic lysis is a general feature of the mechanism of action of *Bacillus thuringiensis*-endotoxins with different insect specificity. Biochim. Biophys. Acta 924:507-518.

Linsmaier, E. M. and F. Skoog (1965) Organic growth factor requirements of tobacco tissue cultures. Physiol. Plant. 18:100-127.

Koller, C. N.; Bauer, L. S.; Hollingworth, R. M. 1992. Characterization of the pH-mediated solubility of *Bacillus thuringiensis* var. san diego native-endotoxin crystals. Biochemical and Biophysical Research Communications 184(2), 692-9.

Li, Jade; Carroll, Joe; Ellar, David J. 1991. Crystal structure of insecticidal-endotoxin from *Bacillus thuringiensis* at 2.5.ANG. resolution. Nature 353(6347), 815-21.

Martinez-Ramirez, A. C.; Real, M. D. 1996. Proteolytic processing of *Bacillus thuringiensis* CryIIIA toxin and specific binding to brush-border membrane vesicles of *Leptinotarsa decemlineata* (Colorado potato beetle). Pesticide Biochemistry and Physiology 54(2), 115-122.

Metcalf, R. L. 1986. In *Methods for the study of the pest Diabrotica*. (eds Krysan, J. L. & Miller, T. A.) vii-xv (Springer-Verlag, New York).

Michaels, T., Narva, K., and Foncerrada, L. 1996. *Bacillus thuringiensis* toxins active against scarab pests. U.S. Pat. No. 5,554,534.

Moellenbeck, Daniel J.; Peters, Melvin L.; Bing, James W.; Rouse, James R.; Higgins, Laura S.; Sims, Lynne; Nevshemall, Tony; Marshall, Lisa; Ellis, R. Tracy; Bystrak, Paul G.; Lang, Bruce A.; Stewart, James L.; Kouba, Kristen; Sondag, Valerie; Gustafson, Vicki; Nour, Katy; Xu, Deping; Swenson, Jan; Zhang, Jian; Czapla, Thomas; Schwab, George; Jayne, Susan; Stockhoff, Brian A.; Narva, Kenneth; Schnepf, H. Ernest; Stelman, Steven J.; Poutre, Candace; Koziel, Michael; Duck, Nicholas. 2001. Insecticidal proteins from *Bacillus thuringiensis* protect corn from corn rootworms. Nature Biotechnology 19(7), 668-672.

Murashige, T. and Skoog, F. (1962) A revised medium for rapid growth and bioassays with tobacco tissue cultures. Physiol. Plant. 15:473-497.

Nunez-Valdez, M.-E.; Sanchez, J.; Lina, L.; Guereca, L.; Bravo, A. 2001. Structural and functional studies of .alpha.-helix 5 region from *Bacillus thuringiensis* Cry1Ab .delta.-endotoxin. Biochimica et Biophysica Acta, Protein Structure and Molecular Enzymology 1546(1), 122-131.

Ochoa-Campuzano, Camila; Real, M. Dolores; Martinez-Ramirez, Amparo C.; Bravo, Alejandra; Rausell, Carolina. 2007. An ADAM metalloprotease is a Cry3Aa *Bacillus thuringiensis* toxin receptor. Biochemical and Biophysical Research Communications 362(2), 437-442.

Oleson, J. D., Park, Y. L., Nowatzki, T. M., and Tollefson, J. J. 2005. Node-Injury Scale to Evaluate Root Injury by Corn Rootworms (Coleoptera: Chrysomelidae). J. Econ. Entom. 98:1-8.

Payne, J. and J. Fu. 1994. Coleopteran-active *bacillus thuringiensis* isolates and genes encoding coleopteran-active toxins. U.S. Pat. No. 5,286,486.

Pigott, Craig R.; Ellar, David J. 2007. Role of receptors in *Bacillus thuringiensis* crystal toxin activity. Microbiology and Molecular Biology Reviews (2007), 71(2), 255-281.

Purcell, John P.; Greenplate, John T.; Sammons, R. Douglas. 1992. Examination of midgut luminal proteinase activities in six economically important insects. Insect Biochemistry and Molecular Biology 22(1), 41-7.

Rausell, C.; Garcia-Robles, I.; Sanchez, J.; Munoz-Garay, C.; Martinez-Ramirez, A. C.; Real, M. D.; Bravo, A. 2004. Role of toxin activation on binding and pore formation activity of the *Bacillus thuringiensis* Cry3 toxins in membranes of *Leptinotarsa decemlineata* (Say). Biochimica et Biophysica Acta, Biomembranes 1660(1-2), 99-105.

Sambrook, J., Fritsch, E. F. & Maniatis, T. (1989) Molecular Cloning: A Laboratory Manual (2nd ed., Cold Spring Harbor Laboratory Press, Plainview, N.Y.)

Schenk, R. U. and Hildebrandt, A. C. (1972) Medium and techniques for induction and growth of monocotyledonous and dicotyledonous plant cell cultures. Can J. Bot. 50:199-204.

Schnepf, E., N. Crickmore, J. Van Rie, D. Lereclus, J. Baum, J. Feitelson, D. R. Zeigler, and D. H. Dean. 1998. *Bacillus* thuringiensis and its pesticidal crystal proteins. Microbiol. Mol. Biol. Rev. 62:775-806.

Sick, A. and T. Gilroy. 1991. *Bacillus thuringiensis* gene encoding a coleopteran-active toxin. U.S. Pat. No. 4,996,155.

Soberon, Mario; Pardo-Lopez, Liliana; Lopez, Idalia; Gomez, Isabel; Tabashnik, Bruce E.; Bravo, Alejandra. 2007. Engineering modified Bt toxins to counter insect resistance. Science 318(5856), 1640-1642.

Steiner, Henry-York, Chen, Eric, and Meghji, Moez. Corn event MIR604. U.S. Pat. No. 7,361,813.

Stewart, L. 2007. Gene synthesis for protein production. Encyclopedia of Life Sciences. John Wiley and Sons.

Stewart, Lance; Burgin, Alex B. 2005 Whole gene synthesis: a gene-o-matic future. Frontiers in Drug Design and Discovery 1 297-341.

Squires, C. H., Retallack, D. M., Chew, L. C., Ramseier, T. M., Schneider, J. C., Talbot, H. W. (2004) Heterologous protein production in *P. fluorescens*. Bioprocess Intern. 2:54-59.

Tabashnik, Bruce E.; Finson, Naomi; Groeters, Francis R.; Moar, William J.; Johnson, Marshall W.; Luo, Ke; Adang, Michael J. 1994. Reversal of resistance to *Bacillus thuringiensis* in *Plutella xylostella*. Proceedings of the National Academy of Sciences of the United States of America (1994), 91(10), 4120-4.

Tabashnik, Bruce E.; Gassmann, Aaron J.; Crowder, David W.; Carriere, Yves. 2008. Insect resistance to Bt crops: evidence versus theory. Nature Biotechnology 26(2), 199-202.

Varshaysky, Alexander. The N-end rule pathway of protein degradation. Genes to Cells (1997), 2(1), 13-28.

Vaughn, Ty; Cavato, Tracey; Brar, Gurdip; Coombe, Timothy; DeGooyer, Todd; Ford, Stephanie; Groth, Mark; Howe, Arlene; Johnson, Scott; Kolacz, Kathryn; Pilcher, Clinton; Purcell, John; Romano, Charles; English, Leigh; Pershing, Jay. 2005. A method of controlling corn rootworm feeding using a *Bacillus thuringiensis* protein expressed in transgenic maize. Crop Science 45(3), 931-938.

Walters, Frederick S.; Slatin, Stephen L.; Kulesza, Caroline A.; English, Leigh H. 1993. Ion channel activity of N-terminal fragments from CryIA(c) delta-endotoxin. Biochemical and Biophysical Research Communications 196(2), 921-6.

Walters, Frederick S.; Stacy, Cheryl M.; Lee, Mi Kyong; Palekar, Narendra; Chen, Jeng S. 2008. An engineered chymotrypsin/cathepsin G site in domain I renders *Bacillus thuringiensis* Cry3A active against western corn rootworm larvae. Applied and Environmental Microbiology 74(2), 367-374.

Weigel, Detlef; Glazebrook, Jane. (2002) *Arabidopsis*: A Laboratory Manual. with different insect specificity. Biochim. Biophys. Acta 924:507-518

US Patent Application No. 20060008877
US Patent Application No. 20080193974
US Patent Application No. 20080058262
WO/2008/151319

SEQUENCE LISTING (466 sequences)

SEQ ID NO: 1 - protein, 562 aa, Bacillus thuringiensis
MFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 2 - protein, 563 aa, Bacillus thuringiensis
MGFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 3 - protein, 561 aa, Bacillus thuringiensis
MGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 4 - protein, 560 aa, Bacillus thuringiensis
MGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 5 - protein, 559 aa, Bacillus thuringiensis
MALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 6 - protein, 558 aa, Bacillus thuringiensis
MLVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 7 - protein, 559 aa, Bacillus thuringiensis
MGLVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 8 - protein, 557 aa, Bacillus thuringiensis
MVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 9 - protein, 558 aa, Bacillus thuringiensis
MGVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 10 - protein, 556 aa, Bacillus thuringiensis
MSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 11 - protein, 557 aa, Bacillus thuringiensis
MGSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 12 - protein, 555 aa, Bacillus thuringiensis
MFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 13 - protein, 556 aa, Bacillus thuringiensis
MGFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 14 - protein, 554 aa, Bacillus thuringiensis
MYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 15 - protein, 555 aa, Bacillus thuringiensis
MGYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 16 - protein, 553 aa, Bacillus thuringiensis
MTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 17 - protein, 554 aa, Bacillus thuringiensis
MGTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 18 - protein, 552 aa, Bacillus thuringiensis
MNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 19 - protein, 553 aa, Bacillus thuringiensis
MGNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 20 - protein, 551 aa, Bacillus thuringiensis
MFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 21 - protein, 552 aa, Bacillus thuringiensis
MGFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 22 - protein, 550 aa, Bacillus thuringiensis
MLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 23 - protein, 551 aa, Bacillus thuringiensis
MGLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 24 - protein, 549 aa, Bacillus thuringiensis
MNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 25 - protein, 550 aa, Bacillus thuringiensis
MGNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 26 - protein, 548 aa, Bacillus thuringiensis
MTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 27 - protein, 549 aa, Bacillus thuringiensis
MGTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 28 - protein, 547 aa, Bacillus thuringiensis
MIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 29 - protein, 548 aa, Bacillus thuringiensis
MGIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 30 - protein, 546 aa, Bacillus thuringiensis
MWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 31 - protein, 547 aa, Bacillus thuringiensis
MGWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 32 - protein, 545 aa, Bacillus thuringiensis
MPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 33 - protein, 546 aa, Bacillus thuringiensis
MGPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 34 - protein, 544 aa, Bacillus thuringiensis
MSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 35 - protein, 545 aa, Bacillus thuringiensis
MGSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 36 - protein, 543 aa, Bacillus thuringiensis
MEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 37 - protein, 544 aa, Bacillus thuringiensis
MGEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 38 - protein, 542 aa, Bacillus thuringiensis
MDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 39 - protein, 543 aa, Bacillus thuringiensis
MGDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 40 - protein, 541 aa, Bacillus thuringiensis
MPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 41 - protein, 542 aa, Bacillus thuringiensis
MGPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 42 - protein, 540 aa, Bacillus thuringiensis
MWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 43 - protein, 541 aa, Bacillus thuringiensis
MGWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 44 - protein, 539 aa, Bacillus thuringiensis
MKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 45 - protein, 540 aa, Bacillus thuringiensis
MGKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 46 - protein, 538 aa, Bacillus thuringiensis
MAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 47 - protein, 539 aa, Bacillus thuringiensis
MGAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 48 - protein, 537 aa, Bacillus thuringiensis
MFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 49 - protein, 538 aa, Bacillus thuringiensis
MGFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 50 - protein, 536 aa, Bacillus thuringiensis
MMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 51 - protein, 537 aa, Bacillus thuringiensis
MGMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 52 - protein, 535 aa, Bacillus thuringiensis
MEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 53 - protein, 536 aa, Bacillus thuringiensis
MGEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 54 - protein, 534 aa, Bacillus thuringiensis
MQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 55 - protein, 535 aa, Bacillus thuringiensis
MGQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 56 - protein, 533 aa, Bacillus thuringiensis
MVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 57 - protein, 534 aa, Bacillus thuringiensis
MGVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 58 - protein, 532 aa, Bacillus thuringiensis
MEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 59 - protein, 533 aa, Bacillus thuringiensis
MGEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 60 - protein, 531 aa, Bacillus thuringiensis
MALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 61 - protein, 532 aa, Bacillus thuringiensis
MGALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 62 - protein, 530 aa, Bacillus thuringiensis
MLMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 63 - protein, 531 aa, Bacillus thuringiensis
MGLMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 64 - protein, 529 aa, Bacillus thuringiensis
MMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 65 - protein, 530 aa, Bacillus thuringiensis
MGMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 66 - protein, 528 aa, Bacillus thuringiensis
MDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 67 - protein, 529 aa, Bacillus thuringiensis
MGDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 68 - protein, 527 aa, Bacillus thuringiensis
MQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 69 - protein, 528 aa, Bacillus thuringiensis
MGQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 70 - protein, 526 aa, Bacillus thuringiensis
MKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 71 - protein, 527 aa, Bacillus thuringiensis
MGKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 72 - protein, 525 aa, Bacillus thuringiensis
MIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 73 - protein, 526 aa, Bacillus thuringiensis
MGIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 74 - protein, 524 aa, Bacillus thuringiensis
MADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 75 - protein, 525 aa, Bacillus thuringiensis
MGADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 76 - protein, 523 aa, Bacillus thuringiensis
MDYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 77 - protein, 524 aa, Bacillus thuringiensis
MGDYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 78 - protein, 522 aa, Bacillus thuringiensis
MYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 79 - protein, 523 aa, Bacillus thuringiensis
MGYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 80 - protein, 521 aa, Bacillus thuringiensis
MAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 81 - protein, 522 aa, Bacillus thuringiensis
MGAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 82 - protein, 520 aa, Bacillus thuringiensis
MKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 83 - protein, 521 aa, Bacillus thuringiensis
MGKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 84 - protein, 519 aa, Bacillus thuringiensis
MNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 85 - protein, 520 aa, Bacillus thuringiensis
MGNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 86 - protein, 518 aa, Bacillus thuringiensis
MKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 87 - protein, 519 aa, Bacillus thuringiensis
MGKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 88 - protein, 517 aa, Bacillus thuringiensis
MALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 89 - protein, 518 aa, Bacillus thuringiensis
MGALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 90 - protein, 516 aa, Bacillus thuringiensis
MLAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 91 - protein, 517 aa, Bacillus thuringiensis
MGLAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 92 - protein, 515 aa, Bacillus thuringiensis
MAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 93 - protein, 516 aa, Bacillus thuringiensis
MGAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 94 - protein, 514 aa, Bacillus thuringiensis
MELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 95 - protein, 515 aa, Bacillus thuringiensis
MGELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 96 - protein, 513 aa, Bacillus thuringiensis
MLQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 97 - protein, 514 aa, Bacillus thuringiensis
MGLQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 98 - protein, 512 aa, Bacillus thuringiensis
MQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 99 - protein, 513 aa, Bacillus thuringiensis
MGQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 100 - protein, 511 aa, Bacillus thuringiensis
MGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 101 - protein, 510 aa, Bacillus thuringiensis
MLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 102 - protein, 511 aa, Bacillus thuringiensis; identical to SEQ ID NO: 100

SEQ ID NO: 103 - protein, 509 aa, Bacillus thuringiensis
MQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 104 - protein, 510 aa, Bacillus thuringiensis
MGQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 105 - protein, 508 aa, Bacillus thuringiensis
MNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 106 - protein, 509 aa, Bacillus thuringiensis
MGNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 107 - protein, 507 aa, Bacillus thuringiensis
MNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 108 - protein, 508 aa, Bacillus thuringiensis
MGNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 109 - protein, 569 aa, Bacillus thuringiensis
MFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 110 - protein, 570 aa, Bacillus thuringiensis
MGFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 111 - protein, 568 aa, Bacillus thuringiensis
MAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 112 - protein, 569 aa, Bacillus thuringiensis
MGAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 113 - protein, 567 aa, Bacillus thuringiensis
MGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 114 - protein, 566 aa, Bacillus thuringiensis
MALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 115 - protein, 567 aa, Bacillus thuringiensis; identical to SEQ ID NO: 113

SEQ ID NO: 116 - protein, 565 aa, Bacillus thuringiensis
MLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 117 - protein, 566 aa, Bacillus thuringiensis
MGLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 118 - protein, 564 aa, Bacillus thuringiensis
MTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 119 - protein, 565 aa, Bacillus thuringiensis
MGTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 120 - protein, 563 aa, Bacillus thuringiensis
MSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 121 - protein, 564 aa, Bacillus thuringiensis
MGSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 122 - protein, 562 aa, Bacillus thuringiensis
MFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 123 - protein, 563 aa, Bacillus thuringiensis
MGFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 124 - protein, 561 aa, Bacillus thuringiensis
MYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 125 - protein, 562 aa, Bacillus thuringiensis
MGYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 126 - protein, 560 aa, Bacillus thuringiensis
MQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 127 - protein, 561 aa, Bacillus thuringiensis
MGQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 128 - protein, 559 aa, Bacillus thuringiensis
MSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 129 - protein, 560 aa, Bacillus thuringiensis
MGSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 130 - protein, 558 aa, Bacillus thuringiensis
MFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 131 - protein, 559 aa, Bacillus thuringiensis
MGFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 132 - protein, 557 aa, Bacillus thuringiensis
MLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 133 - protein, 558 aa, Bacillus thuringiensis
MGLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 134 - protein, 556 aa, Bacillus thuringiensis
MNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 135 - protein, 557 aa, Bacillus thuringiensis
MGNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 136 - protein, 555 aa, Bacillus thuringiensis
MAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 137 - protein, 556 aa, Bacillus thuringiensis
MGAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 138 - protein, 554 aa, Bacillus thuringiensis
MIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 139 - protein, 555 aa, Bacillus thuringiensis
MGIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 140 - protein, 553 aa, Bacillus thuringiensis
MWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 141 - protein, 554 aa, Bacillus thuringiensis
MGWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 142 - protein, 552 aa, Bacillus thuringiensis
MPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 143 - protein, 553 aa, Bacillus thuringiensis
MGPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 144 - protein, 551 aa, Bacillus thuringiensis
MSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 145 - protein, 552 aa, Bacillus thuringiensis
MGSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 146 - protein, 550 aa, Bacillus thuringiensis
MDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 147 - protein, 551 aa, Bacillus thuringiensis
MGDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 148 - protein, 549 aa, Bacillus thuringiensis
MADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 149 - protein, 550 aa, Bacillus thuringiensis
MGADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 150 - protein, 548 aa, Bacillus thuringiensis
MDPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 151 - protein, 549 aa, Bacillus thuringiensis
MGDPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 152 - protein, 547 aa, Bacillus thuringiensis
MPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 153 - protein, 548 aa, Bacillus thuringiensis
MGPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 154 - protein, 546 aa, Bacillus thuringiensis
MWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 155 - protein, 547 aa, Bacillus thuringiensis
MGWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 156 - protein, 545 aa, Bacillus thuringiensis
MKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 157 - protein, 546 aa, Bacillus thuringiensis
MGKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 158 - protein, 544 aa, Bacillus thuringiensis
MAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 159 - protein, 545 aa, Bacillus thuringiensis
MGAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 160 - protein, 543 aa, Bacillus thuringiensis
MFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 161 - protein, 544 aa, Bacillus thuringiensis
MGFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 162 - protein, 542 aa, Bacillus thuringiensis
MMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 163 - protein, 543 aa, Bacillus thuringiensis
MGMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 164 - protein, 541 aa, Bacillus thuringiensis
MAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 165 - protein, 542 aa, Bacillus thuringiensis
MGAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 166 - protein, 540 aa, Bacillus thuringiensis
MQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 167 - protein, 541 aa, Bacillus thuringiensis
MGQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 168 - protein, 539 aa, Bacillus thuringiensis
MVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 169 - protein, 540 aa, Bacillus thuringiensis
MGVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 170 - protein, 538 aa, Bacillus thuringiensis
MEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 171 - protein, 539 aa, Bacillus thuringiensis
MGEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 172 - protein, 537 aa, Bacillus thuringiensis
MVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 173 - protein, 538 aa, Bacillus thuringiensis
MGVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 174 - protein, 536 aa, Bacillus thuringiensis
MLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 175 - protein, 537 aa, Bacillus thuringiensis
MGLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 176 - protein, 535 aa, Bacillus thuringiensis
MIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 177 - protein, 536 aa, Bacillus thuringiensis
MGIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 178 - protein, 534 aa, Bacillus thuringiensis
MDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 179 - protein, 535 aa, Bacillus thuringiensis
MGDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 180 - protein, 533 aa, Bacillus thuringiensis
MKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 181 - protein, 534 aa, Bacillus thuringiensis
MGKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 182 - protein, 532 aa, Bacillus thuringiensis
MKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 183 - protein, 533 aa, Bacillus thuringiensis
MGKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 184 - protein, 531 aa, Bacillus thuringiensis
MIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 185 - protein, 532 aa, Bacillus thuringiensis
MGIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 186 - protein, 530 aa, Bacillus thuringiensis
MEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 187 - protein, 531 aa, Bacillus thuringiensis
MGEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 188 - protein, 529 aa, Bacillus thuringiensis
MEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 189 - protein, 530 aa, Bacillus thuringiensis
MGEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 190 - protein, 528 aa, Bacillus thuringiensis
MYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 191 - protein, 529 aa, Bacillus thuringiensis
MGYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 192 - protein, 527 aa, Bacillus thuringiensis
MAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 193 - protein, 528 aa, Bacillus thuringiensis
MGAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 194 - protein, 526 aa, Bacillus thuringiensis
MKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 195 - protein, 527 aa, Bacillus thuringiensis
MGKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 196 - protein, 525 aa, Bacillus thuringiensis
MSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 197 - protein, 526 aa, Bacillus thuringiensis
MGSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 198 - protein, 524 aa, Bacillus thuringiensis
MKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 199 - protein, 525 aa, Bacillus thuringiensis
MGKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 200 - protein, 523 aa, Bacillus thuringiensis
MALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 201 - protein, 524 aa, Bacillus thuringiensis
MGALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 202 - protein, 522 aa, Bacillus thuringiensis
MLAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 203 - protein, 523 aa, Bacillus thuringiensis
MGLAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 204 - protein, 521 aa, Bacillus thuringiensis
MAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 205 - protein, 522 aa, Bacillus thuringiensis
MGAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 206 - protein, 520 aa, Bacillus thuringiensis
MELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 207 - protein, 521 aa, Bacillus thuringiensis
MGELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 208 - protein, 519 aa, Bacillus thuringiensis
MLQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 209 - protein, 520 aa, Bacillus thuringiensis
MGLQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 210 - protein, 518 aa, Bacillus thuringiensis
MQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 211 - protein, 519 aa, Bacillus thuringiensis
MGQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 212 - protein, 517 aa, Bacillus thuringiensis
MGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 213 - protein, 516 aa, Bacillus thuringiensis
MLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 214 - protein, 517 aa, Bacillus thuringiensis; identical to SEQ ID NO: 212

SEQ ID NO: 215 - protein, 515 aa, Bacillus thuringiensis
MQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 216 - protein, 516 aa, Bacillus thuringiensis
MGQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 217 - protein, 514 aa, Bacillus thuringiensis
MNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 218 - protein, 515 aa, Bacillus thuringiensis
MGNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 219 - protein, 513 aa, Bacillus thuringiensis
MNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 220 - protein, 514 aa, Bacillus thuringiensis
MGNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 221 - protein, 1063 aa, Bacillus thuringiensis
  misc_feature (245)..(245): Xaa can be any naturally occurring amino acid
MGASFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 222 - protein, 1062 aa, Bacillus thuringiensis
  misc_feature (244)..(244): Xaa can be any naturally occurring amino acid
MASFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 223 - protein, 1061 aa, Bacillus thuringiensis
  misc_feature (243)..(243): Xaa can be any naturally occurring amino acid
MSFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 224 - protein, 1062 aa, Bacillus thuringiensis
  misc_feature (244)..(244): Xaa can be any naturally occurring amino acid
MGSFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 225 - protein, 1060 aa, Bacillus thuringiensis
  misc_feature (242)..(242): Xaa can be any naturally occurring amino acid
MFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 226 - protein, 1061 aa, Bacillus thuringiensis
  misc_feature (243)..(243): Xaa can be any naturally occurring amino acid
MGFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 227 - protein, 1059 aa, Bacillus thuringiensis
  misc_feature (241)..(241): Xaa can be any naturally occurring amino acid
MITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 228 - protein, 1060 aa, Bacillus thuringiensis
  misc_feature (242)..(242): Xaa can be any naturally occurring amino acid
MGITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 229 - protein, 1058 aa, Bacillus thuringiensis
  misc_feature (240)..(240): Xaa can be any naturally occurring amino acid
MTNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 230 - protein, 1059 aa, Bacillus thuringiensis
  misc_feature (241)..(241): Xaa can be any naturally occurring amino acid
MGTNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 231 - protein, 1057 aa, Bacillus thuringiensis
  misc_feature (239)..(239): Xaa can be any naturally occurring amino acid
MNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 232 - protein, 1058 aa, Bacillus thuringiensis
  misc_feature (240)..(240): Xaa can be any naturally occurring amino acid
MGNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 233 - protein, 1056 aa, Bacillus thuringiensis
  misc_feature (238)..(238): Xaa can be any naturally occurring amino acid
MFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 234 - protein, 1057 aa, Bacillus thuringiensis
  misc_feature (239)..(239): Xaa can be any naturally occurring amino acid
MGFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 235 - protein, 1055 aa, Bacillus thuringiensis
  misc_feature (237)..(237): Xaa can be any naturally occurring amino acid
MYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 236 - protein, 1056 aa, Bacillus thuringiensis
  misc_feature (238)..(238): Xaa can be any naturally occurring amino acid
MGYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 237 - protein, 1054 aa, Bacillus thuringiensis
  misc_feature (236)..(236): Xaa can be any naturally occurring amino acid
MLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 238 - protein, 1055 aa, Bacillus thuringiensis
  misc_feature (237)..(237): Xaa can be any naturally occurring amino acid
MGLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 239 - protein, 1053 aa, Bacillus thuringiensis
  misc_feature (235)..(235): Xaa can be any naturally occurring amino acid
MKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 240 - protein, 1054 aa, Bacillus thuringiensis
  misc_feature (236)..(236): Xaa can be any naturally occurring amino acid
MGKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 241 - protein, 1052 aa, Bacillus thuringiensis
  misc_feature (234)..(234): Xaa can be any naturally occurring amino acid
MITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 242 - protein, 1053 aa, Bacillus thuringiensis
  misc_feature (235)..(235): Xaa can be any naturally occurring amino acid
MGITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 243 - protein, 1051 aa, Bacillus thuringiensis
  misc_feature (233)..(233): Xaa can be any naturally occurring amino acid
MTGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 244 - protein, 1052 aa, Bacillus thuringiensis
  misc_feature (234)..(234): Xaa can be any naturally occurring amino acid
MGTGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 245 - protein, 1050 aa, Bacillus thuringiensis
  misc_feature (232)..(232): Xaa can be any naturally occurring amino acid
MGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 246 - protein, 1049 aa, Bacillus thuringiensis
  misc_feature (231)..(231): Xaa can be any naturally occurring amino acid
MLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 247 - protein, 1048 aa, Bacillus thuringiensis
  misc_feature (230)..(230): Xaa can be any naturally occurring amino acid
MLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 248 - protein, 1049 aa, Bacillus thuringiensis
  misc_feature (231)..(231): Xaa can be any naturally occurring amino acid
MGLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 249 - protein, 1047 aa, Bacillus thuringiensis
  misc_feature (229)..(229): Xaa can be any naturally occurring amino acid
MWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 250 - protein, 1048 aa, Bacillus thuringiensis
  misc_feature (230)..(230): Xaa can be any naturally occurring amino acid
MGWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 251 - protein, 1046 aa, Bacillus thuringiensis
  misc_feature (228)..(228): Xaa can be any naturally occurring amino acid
MPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 252 - protein, 1047 aa, Bacillus thuringiensis
  misc_feature (229)..(229): Xaa can be any naturally occurring amino acid
MGPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 253 - protein, 1045 aa, Bacillus thuringiensis
  misc_feature (227)..(227): Xaa can be any naturally occurring amino acid
MHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 254 - protein, 1046 aa, Bacillus thuringiensis
  misc_feature (228)..(228): Xaa can be any naturally occurring amino acid
MGHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 255 - protein, 1044 aa, Bacillus thuringiensis
  misc_feature (226)..(226): Xaa can be any naturally occurring amino acid
MNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 256 - protein, 1045 aa, Bacillus thuringiensis
  misc_feature (227)..(227): Xaa can be any naturally occurring amino acid
MGNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 257 - protein, 1043 aa, Bacillus thuringiensis
  misc_feature (225)..(225): Xaa can be any naturally occurring amino acid
MKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 258 - protein, 1044 aa, Bacillus thuringiensis
  misc_feature (226)..(226): Xaa can be any naturally occurring amino acid
MGKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 259 - protein, 1042 aa, Bacillus thuringiensis
  misc_feature (224)..(224): Xaa can be any naturally occurring amino acid
MNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 260 - protein, 1043 aa, Bacillus thuringiensis
  misc_feature (225)..(225): Xaa can be any naturally occurring amino acid
MGNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 261 - protein, 1041 aa, Bacillus thuringiensis
  misc_feature (223)..(223): Xaa can be any naturally occurring amino acid
MIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 262 - protein, 1042 aa, Bacillus thuringiensis
  misc_feature (224)..(224): Xaa can be any naturally occurring amino acid
MGIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 263 - protein, 1040 aa, Bacillus thuringiensis
  misc_feature (222)..(222): Xaa can be any naturally occurring amino acid
MWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 264 - protein, 1041 aa, Bacillus thuringiensis
  misc_feature (223)..(223): Xaa can be any naturally occurring amino acid
MGWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 265 - protein, 1039 aa, Bacillus thuringiensis
  misc_feature (221)..(221): Xaa can be any naturally occurring amino acid
MDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 266 - protein, 1040 aa, Bacillus thuringiensis
  misc_feature (222)..(222): Xaa can be any naturally occurring amino acid
MGDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 267 - protein, 1038 aa, Bacillus thuringiensis
  misc_feature (220)..(220): Xaa can be any naturally occurring amino acid
MEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 268 - protein, 1039 aa, Bacillus thuringiensis
  misc_feature (221)..(221): Xaa can be any naturally occurring amino acid
MGEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 269 - protein, 1037 aa, Bacillus thuringiensis
  misc_feature (219)..(219): Xaa can be any naturally occurring amino acid
MFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 270 - protein, 1038 aa, Bacillus thuringiensis
  misc_feature (220)..(220): Xaa can be any naturally occurring amino acid
MGFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 271 - protein, 1036 aa, Bacillus thuringiensis
  misc_feature (218)..(218): Xaa can be any naturally occurring amino acid
MMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 272 - protein, 1037 aa, Bacillus thuringiensis
  misc_feature (219)..(219): Xaa can be any naturally occurring amino acid
MGMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 273 - protein, 1035 aa, Bacillus thuringiensis
  misc_feature (217)..(217): Xaa can be any naturally occurring amino acid
MTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 274 - protein, 1036 aa, Bacillus thuringiensis
  misc_feature (218)..(218): Xaa can be any naturally occurring amino acid
MGTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 275 - protein, 1034 aa, Bacillus thuringiensis
  misc_feature (216)..(216): Xaa can be any naturally occurring amino acid
MEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 276 - protein, 1035 aa, Bacillus thuringiensis
  misc_feature (217)..(217): Xaa can be any naturally occurring amino acid
MGEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 277 - protein, 1033 aa, Bacillus thuringiensis
  misc_feature (215)..(215): Xaa can be any naturally occurring amino acid
MVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 278 - protein, 1034 aa, Bacillus thuringiensis
  misc_feature (216)..(216): Xaa can be any naturally occurring amino acid
MGVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 279 - protein, 1032 aa, Bacillus thuringiensis
  misc_feature (214)..(214): Xaa can be any naturally occurring amino acid
METLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 280 - protein, 1033 aa, Bacillus thuringiensis
  misc_feature (215)..(215): Xaa can be any naturally occurring amino acid
MGETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 281 - protein, 1031 aa, Bacillus thuringiensis
  misc_feature (213)..(213): Xaa can be any naturally occurring amino acid
MTLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 282 - protein, 1032 aa, Bacillus thuringiensis
  misc_feature (214)..(214): Xaa can be any naturally occurring amino acid
MGTLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 283 - protein, 1030 aa, Bacillus thuringiensis
  misc_feature (212)..(212): Xaa can be any naturally occurring amino acid
MLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 284 - protein, 1031 aa, Bacillus thuringiensis
  misc_feature (213)..(213): Xaa can be any naturally occurring amino acid
MGLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 285 - protein, 1029 aa, Bacillus thuringiensis
  misc_feature (211)..(211): Xaa can be any naturally occurring amino acid
MIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 286 - protein, 1030 aa, Bacillus thuringiensis
  misc_feature (212)..(212): Xaa can be any naturally occurring amino acid
MGIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 287 - protein, 1028 aa, Bacillus thuringiensis
  misc_feature (210)..(210): Xaa can be any naturally occurring amino acid
MEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 288 - protein, 1029 aa, Bacillus thuringiensis
  misc_feature (211)..(211): Xaa can be any naturally occurring amino acid
MGEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 289 - protein, 1027 aa, Bacillus thuringiensis
  misc_feature (209)..(209): Xaa can be any naturally occurring amino acid
MQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 290 - protein, 1028 aa, Bacillus thuringiensis
  misc_feature (210)..(210): Xaa can be any naturally occurring amino acid
MGQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 291 - protein, 1026 aa, Bacillus thuringiensis
  misc_feature (208)..(208): Xaa can be any naturally occurring amino acid
MKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 292 - protein, 1027 aa, Bacillus thuringiensis
  misc_feature (209)..(209): Xaa can be any naturally occurring amino acid
MGKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 293 - protein, 1025 aa, Bacillus thuringiensis
  misc_feature (207)..(207): Xaa can be any naturally occurring amino acid
MIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 294 - protein, 1026 aa, Bacillus thuringiensis
  misc_feature (208)..(208): Xaa can be any naturally occurring amino acid
MGIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 295 - protein, 1024 aa, Bacillus thuringiensis
  misc_feature (206)..(206): Xaa can be any naturally occurring amino acid
MEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 296 - protein, 1025 aa, Bacillus thuringiensis
  misc_feature (207)..(207): Xaa can be any naturally occurring amino acid
MGEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 297 - protein, 1023 aa, Bacillus thuringiensis
  misc_feature (205)..(205): Xaa can be any naturally occurring amino acid
MQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 298 - protein, 1024 aa, Bacillus thuringiensis
  misc_feature (206)..(206): Xaa can be any naturally occurring amino acid
MGQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 299 - protein, 1022 aa, Bacillus thuringiensis
  misc_feature (204)..(204): Xaa can be any naturally occurring amino acid
MYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 300 - protein, 1023 aa, Bacillus thuringiensis
  misc_feature (205)..(205): Xaa can be any naturally occurring amino acid
MGYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 301 - protein, 1021 aa, Bacillus thuringiensis
  misc_feature (203)..(203): Xaa can be any naturally occurring amino acid
MARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 302 - protein, 1022 aa, Bacillus thuringiensis
  misc_feature (204)..(204): Xaa can be any naturally occurring amino acid
MGARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 303 - protein, 1020 aa, Bacillus thuringiensis
  misc_feature (202)..(202): Xaa can be any naturally occurring amino acid
MRNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 304 - protein, 1021 aa, Bacillus thuringiensis
  misc_feature (203)..(203): Xaa can be any naturally occurring amino acid
MGRNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 305 - protein, 1019 aa, Bacillus thuringiensis
  misc_feature (201)..(201): Xaa can be any naturally occurring amino acid
MNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 306 - protein, 1020 aa, Bacillus thuringiensis
  misc_feature (202)..(202): Xaa can be any naturally occurring amino acid
MGNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 307 - protein, 1018 aa, Bacillus thuringiensis
  misc_feature (200)..(200): Xaa can be any naturally occurring amino acid
MKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 308 - protein, 1019 aa, Bacillus thuringiensis
  misc_feature (201)..(201): Xaa can be any naturally occurring amino acid
MGKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 309 - protein, 1017 aa, Bacillus thuringiensis
  misc_feature (199)..(199): Xaa can be any naturally occurring amino acid
MALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 310 - protein, 1018 aa, Bacillus thuringiensis
  misc_feature (200)..(200): Xaa can be any naturally occurring amino acid
MGALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 311 - protein, 1016 aa, Bacillus thuringiensis
  misc_feature (198)..(198): Xaa can be any naturally occurring amino acid
MLAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 312 - protein, 1017 aa, Bacillus thuringiensis
  misc_feature (199)..(199): Xaa can be any naturally occurring amino acid
MGLAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 313 - protein, 1015 aa, Bacillus thuringiensis
  misc_feature (197)..(197): Xaa can be any naturally occurring amino acid
MAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 314 - protein, 1016 aa, Bacillus thuringiensis
  misc_feature (198)..(198): Xaa can be any naturally occurring amino acid
MGAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 315 - protein, 1014 aa, Bacillus thuringiensis
  misc_feature (196)..(196): Xaa can be any naturally occurring amino acid
MELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 316 - protein, 1015 aa, Bacillus thuringiensis
  misc_feature (197)..(197): Xaa can be any naturally occurring amino acid
MGELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 317 - protein, 1013 aa, Bacillus thuringiensis
  misc_feature (195)..(195): Xaa can be any naturally occurring amino acid
MLEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 318 - protein, 1014 aa, Bacillus thuringiensis
  misc_feature (196)..(196): Xaa can be any naturally occurring amino acid
MGLEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 319 - protein, 1012 aa, Bacillus thuringiensis
  misc_feature (194)..(194): Xaa can be any naturally occurring amino acid
MEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 320 - protein, 1013 aa, Bacillus thuringiensis
  misc_feature (195)..(195): Xaa can be any naturally occurring amino acid
MGEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 321 - protein, 1011 aa, Bacillus thuringiensis
  misc_feature (193)..(193): Xaa can be any naturally occurring amino acid
MGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 322 - protein, 1010 aa, Bacillus thuringiensis
  misc_feature (192)..(192): Xaa can be any naturally occurring amino acid
MLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 323 - protein, 1009 aa, Bacillus thuringiensis
  misc_feature (191)..(191): Xaa can be any naturally occurring amino acid
MGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 324 - protein, 1008 aa, Bacillus thuringiensis
  misc_feature (190)..(190): Xaa can be any naturally occurring amino acid
MNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 325 - protein, 1007 aa, Bacillus thuringiensis
  misc_feature (189)..(189): Xaa can be any naturally occurring amino acid
MNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 326 - protein, 1008 aa, Bacillus thuringiensis
  misc_feature (190)..(190): Xaa can be any naturally occurring amino acid
MGNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 327 - protein, 1083 aa, Bacillus thuringiensis
MFVGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 328 - protein, 1084 aa, Bacillus thuringiensis
MGFVGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 329 - protein, 1082 aa, Bacillus thuringiensis
MVGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 330 - protein, 1083 aa, Bacillus thuringiensis
MGVGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 331 - protein, 1081 aa, Bacillus thuringiensis
MGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 332 - protein, 1080 aa, Bacillus thuringiensis
MPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 333 - protein, 1079 aa, Bacillus thuringiensis
MIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 334 - protein, 1080 aa, Bacillus thuringiensis
MGIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 335 - protein, 1078 aa, Bacillus thuringiensis
MVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 336 - protein, 1079 aa, Bacillus thuringiensis
MGVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 337 - protein, 1077 aa, Bacillus thuringiensis
MSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 338 - protein, 1078 aa, Bacillus thuringiensis
MGSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 339 - protein, 1076 aa, Bacillus thuringiensis
MLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 340 - protein, 1077 aa, Bacillus thuringiensis
MGLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 341 - protein, 1075 aa, Bacillus thuringiensis
MYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 342 - protein, 1076 aa, Bacillus thuringiensis
MGYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 343 - protein, 1074 aa, Bacillus thuringiensis
MTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 344 - protein, 1075 aa, Bacillus thuringiensis
MGTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 345 - protein, 1073 aa, Bacillus thuringiensis
MQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 346 - protein, 1074 aa, Bacillus thuringiensis
MGQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 347 - protein, 1072 aa, Bacillus thuringiensis
MLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 348 - protein, 1073 aa, Bacillus thuringiensis
MGLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 349 - protein, 1071 aa, Bacillus thuringiensis
MIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 350 - protein, 1072 aa, Bacillus thuringiensis
MGIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 351 - protein, 1070 aa, Bacillus thuringiensis
MDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 352 - protein, 1071 aa, Bacillus thuringiensis
MGDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 353 - protein, 1069 aa, Bacillus thuringiensis
MILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 354 - protein, 1070 aa, Bacillus thuringiensis
MGILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 355 - protein, 1068 aa, Bacillus thuringiensis
MLWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 356 - protein, 1069 aa, Bacillus thuringiensis
MGLWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 357 - protein, 1067 aa, Bacillus thuringiensis
MWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 358 - protein, 1068 aa, Bacillus thuringiensis
MGWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 359 - protein, 1066 aa, Bacillus thuringiensis
MPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 360 - protein, 1067 aa, Bacillus thuringiensis
MGPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 361 - protein, 1065 aa, Bacillus thuringiensis
MSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 362 - protein, 1066 aa, Bacillus thuringiensis
MGSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 363 - protein, 1064 aa, Bacillus thuringiensis
MKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 364 - protein, 1065 aa, Bacillus thuringiensis
MGKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 365 - protein, 1063 aa, Bacillus thuringiensis
MQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 366 - protein, 1064 aa, Bacillus thuringiensis
MGQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 367 - protein, 1062 aa, Bacillus thuringiensis
MKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 368 - protein, 1063 aa, Bacillus thuringiensis
MGKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 369 - protein, 1061 aa, Bacillus thuringiensis
MSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 370 - protein, 1062 aa, Bacillus thuringiensis
MGSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 371 - protein, 1060 aa, Bacillus thuringiensis
MQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 372 - protein, 1061 aa, Bacillus thuringiensis
MGQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 373 - protein, 1059 aa, Bacillus thuringiensis
MWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 374 - protein, 1060 aa, Bacillus thuringiensis
MGWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 375 - protein, 1058 aa, Bacillus thuringiensis
MEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 376 - protein, 1059 aa, Bacillus thuringiensis
MGEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 377 - protein, 1057 aa, Bacillus thuringiensis
MIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 378 - protein, 1058 aa, Bacillus thuringiensis
MGIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 379 - protein, 1056 aa, Bacillus thuringiensis
MFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 380 - protein, 1057 aa, Bacillus thuringiensis
MGFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 381 - protein, 1055 aa, Bacillus thuringiensis
MMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 382 - protein, 1056 aa, Bacillus thuringiensis
MGMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 383 - protein, 1054 aa, Bacillus thuringiensis
MEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 384 - protein, 1055 aa, Bacillus thuringiensis
MGEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 385 - protein, 1053 aa, Bacillus thuringiensis
MQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 386 - protein, 1054 aa, Bacillus thuringiensis
MGQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 387 - protein, 1052 aa, Bacillus thuringiensis
MVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 388 - protein, 1053 aa, Bacillus thuringiensis
MGVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 389 - protein, 1051 aa, Bacillus thuringiensis
MEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 390 - protein, 1052 aa, Bacillus thuringiensis
MGEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 391 - protein, 1050 aa, Bacillus thuringiensis
MELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 392 - protein, 1051 aa, Bacillus thuringiensis
MGELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 393 - protein, 1049 aa, Bacillus thuringiensis
MLINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 394 - protein, 1050 aa, Bacillus thuringiensis
MGLINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 395 - protein, 1048 aa, Bacillus thuringiensis
MINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 396 - protein, 1049 aa, Bacillus thuringiensis
MGINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 397 - protein, 1047 aa, Bacillus thuringiensis
MNQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 398 - protein, 1048 aa, Bacillus thuringiensis
MGNQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 399 - protein, 1046 aa, Bacillus thuringiensis
MQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 400 - protein, 1047 aa, Bacillus thuringiensis
MGQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 401 - protein, 1045 aa, Bacillus thuringiensis
MKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 402 - protein, 1046 aa, Bacillus thuringiensis
MGKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 403 - protein, 1044 aa, Bacillus thuringiensis
MIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 404 - protein, 1045 aa, Bacillus thuringiensis
MGIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 405 - protein, 1043 aa, Bacillus thuringiensis
MAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 406 - protein, 1044 aa, Bacillus thuringiensis
MGAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 407 - protein, 1042 aa, Bacillus thuringiensis
MEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 408 - protein, 1043 aa, Bacillus thuringiensis
MGEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 409 - protein, 1041 aa, Bacillus thuringiensis
MYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 410 - protein, 1042 aa, Bacillus thuringiensis
MGYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 411 - protein, 1040 aa, Bacillus thuringiensis
MARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 412 - protein, 1041 aa, Bacillus thuringiensis
MGARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 413 - protein, 1039 aa, Bacillus thuringiensis
MRNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 414 - protein, 1040 aa, Bacillus thuringiensis
MGRNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 415 - protein, 1038 aa, Bacillus thuringiensis
MNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 416 - protein, 1039 aa, Bacillus thuringiensis
MGNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 417 - protein, 1037 aa, Bacillus thuringiensis
MKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 418 - protein, 1038 aa, Bacillus thuringiensis
MGKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 419 - protein, 1036 aa, Bacillus thuringiensis
MALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 420 - protein, 1037 aa, Bacillus thuringiensis
MGALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 421 - protein, 1035 aa, Bacillus thuringiensis
MLSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 422 - protein, 1036 aa, Bacillus thuringiensis
MGLSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 423 - protein, 1034 aa, Bacillus thuringiensis
MSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 424 - protein, 1035 aa, Bacillus thuringiensis
MGSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 425 - protein, 1033 aa, Bacillus thuringiensis
MELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 426 - protein, 1034 aa, Bacillus thuringiensis
MGELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 427 - protein, 1032 aa, Bacillus thuringiensis
MLEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 428 - protein, 1033 aa, Bacillus thuringiensis
MGLEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 429 - protein, 1031 aa, Bacillus thuringiensis
MEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 430 - protein, 1032 aa, Bacillus thuringiensis
MGEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 431 - protein, 1030 aa, Bacillus thuringiensis
MGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 432 - protein, 1029 aa, Bacillus thuringiensis
MLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 433 - protein, 1028 aa, Bacillus thuringiensis
MGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 434 - protein, 1027 aa, Bacillus thuringiensis
MNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 435 - protein, 1026 aa, Bacillus thuringiensis
MNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 436 - protein, 1027 aa, Bacillus thuringiensis
MGNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 437 - protein, 652 aa, Bacillus thuringiensis
MIRKGGRKMNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 438 - protein, 659 aa, Bacillus thuringiensis
MIRMGGRKMNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 439 - protein, 1138 aa, Bacillus thuringiensis
  misc_feature (320)..(320): Xaa can be any naturally occurring amino acid
MNLNNLGGYEDSNRTLNNSLNYPTQKALSPSLKNMNYQDFLSITEREQPEALASGNTAINTVVSVTGATLSALGVPGASFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAXRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 440 - protein, 1169 aa, Bacillus thuringiensis
MSPNNQNEYEIIDATPSTSVSNDSNRYPFANEPTNALQNMDYKDYLKMSAGNVSEYPGSPEVFLSEQDAVKAAIDIVGKLLTGLGVPFVGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYNDQTGYITKTVTFIPYTNQMWIEISETEGTFYIESVELIVDVE

SEQ ID NO: 441 - DNA, 1953 bp, Bacillus thuringiensis
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttccatttgctggggcgctcacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 442 - protein, 651 aa, Bacillus thuringiensis
MNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 443 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttgatagtaaaacaactttaccactcacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 444 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVGQILGVVGVDSKTTLPLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 445 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttactttaccaagacattcaccactcacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 446 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVGQILGVVGVTLPRHSPLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 447 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttgaagcattagctagtggtccactcacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 448 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVGQILGVVGVEALASGPLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 449 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttgatagtaaaacaactttagatttaacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 450 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVGQILGVVGVDSKTTLDLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 451 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttactttaccaagacattcagatttaacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 452 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVGQILGVVGVTLPRHSDLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 453 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggagattctgttgtaggacagattttaggtgttgtaggggttgatagtaaaacaactttagatttaacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 454 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGDSVVGQILGVVGVDSKTTLDLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 455 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtagatcagattttaggtgttgtaggggttgatagtaaaacaactttagatttaacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 456 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVDQILGVVGVDSKTTLDLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 457 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggagattctgttgtagatcagattttaggtgttgtaggggttgatagtaaaacaactttagatttaacttcattttatcaatcatttcttaacgctatatggccaagtgatgctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 458 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGDSVVDQILGVVGVDSKTTLDLTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 459 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttccatttgctggggcgctcacttcattttatcaatcatttcttaacgctatatggccaagacattcaccagctgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 460 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPRHSPADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 461 - DNA, 1959 bp, Artificial Sequence
  Protease site insertion variant
atgaatccaaacaatcgaagtgaatatgatacgataaaggttacacctaacagtgaattgccaactaaccataatcaatatcctttagctgacaatccaaattcgacactagaagaattaaattataaagaatttttaagaatgactgcagacaattctacggaagtgctagacagctctacagtaaaagatgcagttgggacaggaatttctgttgtaggacagattttaggtgttgtaggggttccatttgctggggcgctcacttcattttatcaatcatttcttaacgctatatggccagaagcattagctagtgacccatggaaggcttttatggcacaagtggaagtactgatagataagaaaatagaggagtatgctaaaagtaaagctcttgcagagttacagggtcttcaaaataattttgaagattatgtaaatgcgttggattcctggaagaaagcgcctgtaaatttacgaagtcgaagaagccaagatcgaataagagaacttttttctcaagcagaaagccattttcgtaattccatgccgtcatttgcggtttccaaattcgaagttctgtttctaccaacatatgcacaagctgcaaatacacatttattgctattaaaagatgctcaagtttttggagaagaatggggatattcttcagaagatattgctgaattttatcaaagacaattaaaacttacgcaacaatacactgaccattgtgtcaattggtataatgttggattaaatagtttaagaggttcaacttatgatgcatgggtcaaatttaaccgttttcgcagagaaatgacattaactgtattagatctaattgtattattcccattttatgatgttcggttatactcaaaaggagttaaaacagaactaacaagagacatttttacagatccaatttttacactcaatgctcttcaagagtatggaccaactttttcgagtatagaaaactctattcgaaaacctcatttatttgattatttgcgtgggattgaatttcatacgcgtcttcgacctggttactctgggaaagattctttcaattattggtctggtaattatgtagaaactagacctagtataggatctaatgatacaatcacttccccattttatggagataaatctattgaacctatacaaaagctaagctttgatggacaaaaagtttatcgaactatagctaatacagacatagcggcttttccggatggcaagatatattttggtgttacgaaagttgattttagtcaatatgatgatcaaaaaaatgaaactagtacacaaacatatgattcaaaaagatacaatggctatttaggtgcacaggattctatcgaccaattaccaccagaaacaacagatgaaccacttgaaaaagcatatagtcatcagcttaattacgcagaatgtttcttaatgcaggaccgtcgtggaacaattccattttttacttggacacatagaagtgtagacttttttaatacaattgatgctgaaaaaattactcaacttccagtagtgaaagcatatgccttgtcttcaggcgcttccattattgaaggtccaggattcacaggaggaaatttactattcctaaaagaatctagtaattcaattgctaaatttaaagttaccttaaattcagcagccttgttacaacgatatcgcgtaagaatacgctatgcttcaaccactaacctacgacttttcgtgcaaaattcaaacaatgattttcttgtcatctacattaataaaactatgaatatagatggtgatttaacatatcaaacatttgatttcgcaactagtaattctaatatgggattctctggtgatacaaatgactttataataggagcagaatctttcgtttctaatgaaaaaatctatatagataagatagaatttatcccagtacaa

SEQ ID NO: 462 - protein, 653 aa, Artificial Sequence
  Protease site insertion variant
MNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPEALASDPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 463 - protein, 1155 aa, Unknown
  Coleopteran-active Cry1Ab
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYLTYLYQKIDESKLKAYTRYQLRGYIEDSQDLEIYLIRYNAKHETVNVPGTGSLWRLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 464 - protein, 1156 aa, Unknown
  Coleopteran-active Cry1Ac
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAESDLERAQKAVNALFTSSNQIGLKTDVTDYHIDRVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 465 - protein, 1182 aa, Unknown
  Coleopteran-active Cry1Ah
MKNSIKLSELWYFNERKWRYFMEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGVDDVFKENYVTLSGTFDECYPTYLYQKIDESKLKAFTRYQLRGYIEDSQDLEVYLIRYNAKHETLNVPGTGSLWPLAVKSPIGRCGEPNRCAHHSHHFSLDIDVGCTDLNEDLGVWVIFKIKTQDGHAKIGNLEFLEEKLLLGEALARVKKAEKKWRDKREKLEWETNIVYKEAKESVDALFVDSQYNRLQTDTNIAMIHAADKRVHRIREAYLPELSVIPGVNAAIFEELEGLIFTAFSLYDARNVIKNGDFNYGLSCWNVKGHVDVEEQNNHRSVLVIPEWEAEVSQEVRVCPGRGYILRVTAYKEGYGEGCVTIHEIEDNTDELKFSNCVEEEVYPNNTVTCNDYTATQEEYEGTYTSRNRGYDGAYESNSSVPADYASAYEEKAYTDGRRDNPCESNRGYRDYTPLPAGYVTKELEYFPETDKVWIEIGETEGTFIVDSVELLLMEE

SEQ ID NO: 466 - protein, 1148 aa, Unknown
  Coleopteran-active Cry1Fa
MENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATLEAESDLERAQKAVNALFTSSNQIGLKTDVTDYHIDRVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

The invention claimed is:

1. A Cry3A protein having a protease cleavage site inserted between α-Helix2A and α-Helix2B in domain I.

2. The protein of claim 1 wherein said protein is a Cry3Aa protein.

3. A method of inhibiting an insect, said method comprising providing the protein of claim 1 to said insect for ingestion.

4. A polynucleotide encoding the protein of claim 1.

5. A plant cell comprising the polynucleotide of claim 4.

6. A plant comprising a plurality of the plant cell of claim 5.

7. A method of protecting a plant from insect damage, said method comprising providing the protein of claim 1 to said insect for ingestion.

8. The method of claim 7, wherein said protein is produced by and is present in said plant.

9. The protein of claim 1, wherein said protease cleavage site is more susceptible to cleavage by an insect protease than by a plant protease.

* * * * *